US011946023B2

(12) United States Patent
DiCosimo et al.

(10) Patent No.: US 11,946,023 B2
(45) Date of Patent: Apr. 2, 2024

(54) GLUCAN FIBER COMPOSITIONS FOR USE IN LAUNDRY CARE AND FABRIC CARE

(71) Applicant: Nutrition & Biosciences USA 4, Inc., Rochester, NY (US)

(72) Inventors: Robert DiCosimo, Chadds Ford, PA (US); Qiong Cheng, Wilmington, DE (US); Rakesh Nambiar, West Chester, PA (US); Jayme L. Paullin, Exton, PA (US); Mark S. Payne, Wilmington, DE (US); Jahnavi Chandra Prasad, Wilmington, DE (US); Zheng You, Hoffman Estates, IL (US)

(73) Assignee: Nutrition & Biosciences USA 4, Inc., Rochester, NY (US)

( * ) Notice: Subject to any disclaimer, the term of this patent is extended or adjusted under 35 U.S.C. 154(b) by 0 days.

(21) Appl. No.: 17/587,419

(22) Filed: Jan. 28, 2022

(65) Prior Publication Data

US 2022/0282183 A1 Sep. 8, 2022

Related U.S. Application Data

(63) Continuation of application No. 16/416,318, filed on May 20, 2019, now abandoned, which is a continuation of application No. 15/765,538, filed as application No. PCT/US2016/060820 on Nov. 7, 2016, now Pat. No. 10,876,074.

(60) Provisional application No. 62/255,155, filed on Nov. 13, 2015.

(51) Int. Cl.

| | |
|---|---|
| ***C11D 1/00*** | (2006.01) |
| ***B08B 3/04*** | (2006.01) |
| ***C11D 3/00*** | (2006.01) |
| ***C11D 3/22*** | (2006.01) |
| ***C11D 3/386*** | (2006.01) |

(52) U.S. Cl.

CPC .............. *C11D 3/222* (2013.01); *C11D 3/001* (2013.01)

(58) Field of Classification Search

CPC .. C11D 1/00; C11D 3/22; C11D 3/222; C11D 3/223; C11D 3/225; C11D 3/227; C11D 3/386; B08B 3/04

See application file for complete search history.

(56) References Cited

U.S. PATENT DOCUMENTS

2015/0240278 A1* 8/2015 Nagy ...................... C12P 19/16 435/97

* cited by examiner

*Primary Examiner* — Brian P Mruk

(57) ABSTRACT

An enzymatically produced α-glucan oligomer/polymer compositions is provided. The enzymatically produced α-glucan oligomer/polymers can be derivatized into α-glucan ether compounds. The α-glucan oligomers/polymers and the corresponding α-glucan ethers are cellulose and/or protease resistant, making them suitable for use in fabric care and laundry care applications. Methods for the production and use of the present compositions are also provided.

26 Claims, No Drawings

Specification includes a Sequence Listing.

GLUCAN FIBER COMPOSITIONS FOR USE IN LAUNDRY CARE AND FABRIC CARE

CROSS-REFERENCE TO RELATED APPLICATION

This application is a continuation of U.S. application Ser. No. 16/416,318 (filed May 20, 2019, now abandoned), which is a continuation of U.S. application Ser. No. 15/765,538 (filed Apr. 3, 2018, now U.S. Pat. No. 10,876,074), which is the National Stage application of International Application No. PCT/US16/60820 (filed Nov. 7, 2016), which claims the benefit of priority of U.S. Provisional Application No. 62/255,155 (filed Nov. 13, 2015), all of which prior applications are incorporated herein by reference in their entirety.

INCORPORATION BY REFERENCE OF THE SEQUENCE LISTING

The Official copy of the sequence is submitted electronically via EFS-Web as an ASCII formatted sequence listing with a file named 20161104_CL6276WOPCT_SequenceListing_ST25.txt created on Nov. 2, 2016 and having a size of 997,548 bytes and is filed concurrently with the specification. The sequence listing contained in this ASCII-formatted document is part of the specification and is herein incorporated by reference herein in its entirety.

FIELD OF THE DISCLOSURE

This disclosure relates to oligosaccharides, polysaccharides, and derivatives thereof. Specially, the disclosure pertains to certain α-glucan polymers, derivatives of these α-glucans such as α-glucan ethers, and their use in fabric care and laundry care applications.

BACKGROUND

Driven by a desire to find new structural polysaccharides using enzymatic syntheses or genetic engineering of microorganisms, researchers have discovered oligosaccharides and polysaccharides that are biodegradable and can be made economically from renewably sourced feedstocks.

Various saccharide oligomer compositions have been reported in the art. For example, U.S. Pat. No. 6,486,314 discloses an α-glucan comprising at least 20, up to about 100,000 α-anhydroglucose units, 38-48% of which are 4-linked anhydroglucose units, 17-28% are 6-linked anhydroglucose units, and 7-20% are 4,6-linked anhydroglucose units and/or gluco-oligosaccharides containing at least two 4-linked anhydroglucose units, at least one 6-linked anhydroglucose unit and at least one 4,6-linked anhydroglucose unit. U.S. Patent Appl. Pub. No. 2010-0284972A1 discloses a composition for improving the health of a subject comprising an α-(1,2)-branched α-(1,6) oligodextran. U.S. Patent Appl. Pub. No. 2011-0020496A1 discloses a branched dextrin having a structure wherein glucose or isomaltooligosaccharide is linked to a non-reducing terminus of a dextrin through an α-(1,6) glycosidic bond and having a DE of 10 to 52. U.S. Pat. No. 6,630,586 discloses a branched maltodextrin composition comprising 22-35% (1,6) glycosidic linkages; a reducing sugars content of <20%; a polymolecularity index (Mp/Mn) of <5; and number average molecular weight (Mn) of 4500 g/mol or less. U.S. Pat. No. 7,612,198 discloses soluble, highly branched glucose polymers, having a reducing sugar content of less than 1%, a level of α-(1,6) glycosidic bonds of between 13 and 17% and a molecular weight having a value of between $0.9\times10^5$ and $1.5\times10^5$ daltons, wherein the soluble highly branched glucose polymers have a branched chain length distribution profile of 70 to 85% of a degree of polymerization (DP) of less than 15, of 10 to 14% of DP of between 15 and 25 and of 8 to 13% of DP greater than 25.

Poly α-1,3-glucan has been isolated by contacting an aqueous solution of sucrose with a glucosyltransferase (gtf) enzyme isolated from *Streptococcus salivarius* (Simpson et al., *Microbiology* 141:1451-1460, 1995). U.S. Pat. No. 7,000,000 disclosed the preparation of a polysaccharide fiber using an *S. salivarius* gtfJ enzyme. At least 50% of the hexose units within the polymer of this fiber were linked via α-1,3-glycosidic linkages. The disclosed polymer formed a liquid crystalline solution when it was dissolved above a critical concentration in a solvent or in a mixture comprising a solvent. From this solution continuous, strong, cotton-like fibers, highly suitable for use in textiles, were spun and used.

Development of new glucan polysaccharides and derivatives thereof is desirable given their potential utility in various applications. It is also desirable to identify glucosyltransferase enzymes that can synthesize new glucan polysaccharides, especially those with mixed glycosidic linkages, and derivatives thereof. The materials would be attractive for use in fabric care and laundry care applications to alter rheology, act as a structuring agent, provide a benefit (preferably a surface substantive effect) to a treated fabric, textile and/or article of clothing (such as improved fabric hand, improved resistance to soil deposition, etc.). Many applications, such as laundry care, often include enzymes such as cellulases, proteases, amylases, and the like. As such, the glucan polysaccharides are preferably resistant to cellulase, amylase, and/or protease activity.

SUMMARY

In one embodiment, a fabric care composition is provided comprising:

a. an α-glucan oligomer/polymer composition comprising:
   i. at least 75% α-(1,3) glycosidic linkages;
   ii. less than 25% α-(1,6) glycosidic linkages;
   iii. less than 10% α-(1,3,6) glycosidic linkages;
   iv. a weight average molecular weight of less than 5000 Daltons;
   v. a viscosity of less than 0.25 Pascal second (Pa·s) at 12 wt % in water 20° C.;
   vi. a solubility of at least 20% (w/w) in water at 25° C.; and
   vii. a polydispersity index of less than 5; and
b. at least one additional fabric care ingredient.

In another embodiment, a laundry care composition is provided comprising:

a. an α-glucan oligomer/polymer composition comprising:
   i. at least 75% α-(1,3) glycosidic linkages;
   ii. less than 25% α-(1,6) glycosidic linkages;
   iii. less than 10% α-(1,3,6) glycosidic linkages;
   iv. a weight average molecular weight of less than 5000 Daltons;
   v. a viscosity of less than 0.25 Pascal second (Pa·s) at 12 wt % in water 20° C.;
   vi. a solubility of at least 20% (w/w) in water at 25° C.; and
   vii. a polydispersity index of less than 5; and b. at least one additional laundry care ingredient.

In another embodiment, the additional ingredient in the above fabric care composition or the above laundry care composition is at least one cellulase, at least one protease, or a combination thereof.

In another embodiment, the fabric care composition or the laundry care composition comprises 0.01 to 90% wt % of the soluble α-glucan oligomer/polymer composition.

In another embodiment, the fabric care composition or the laundry care composition comprises at least one additional ingredient comprising at least one of surfactants (anionic, nonionic, cationic, or zwitterionic), enzymes (proteases, cellulases, polyesterases, amylases, cutinases, lipases, pectate lyases, perhydrolases, xylanases, peroxidases, and/or laccases in any combination), detergent builders, complexing agents, polymers (in addition to the present α-glucan oligomers/polymers and/or α-glucan ethers), soil release polymers, surfactancy-boosting polymers, bleaching systems, bleach activators, bleaching catalysts, fabric conditioners, clays, foam boosters, suds suppressors (silicone or fatty-acid based), anti-corrosion agents, soil-suspending agents, anti-soil redeposition agents, dyes, bactericides, tarnish inhibiters, optical brighteners, perfumes, saturated or unsaturated fatty acids, dye transfer inhibiting agents, chelating agents, hueing dyes, calcium and magnesium cations, visual signaling ingredients, anti-foam, structurants, thickeners, anti-caking agents, starch, sand, gelling agents, and any combination thereof.

In another embodiment, a fabric care and/or laundry care composition is provided wherein the composition is in the form of a liquid, a gel, a powder, a hydrocolloid, an aqueous solution, granules, tablets, capsules, single compartment sachets, multi-compartment sachets or any combination thereof.

In another embodiment, the fabric care composition or the laundry care composition is packaged in a unit dose format.

Various glucan ethers may be produced from the present α-glucan oligomers/polymers. In another embodiment, an α-glucan ether composition is provided comprising:

i. at least 75% α-(1,3) glycosidic linkages;
ii. less than 25% α-(1,6) glycosidic linkages;
iii. less than 10% α-(1,3,6) glycosidic linkages;
iv. a weight average molecular weight of less than 5000 Daltons;
v. a viscosity of less than 0.25 Pascal second (Pa·s) at 12 wt % in water 20° C.;
vi. a solubility of at least 20% (w/w) in water at 25° C.; and
vii. a polydispersity index of less than 5; wherein the glucan ether composition has a degree of substitution (DoS) with at least one organic group of about 0.05 to about 3.0.

The α-glucan ether compositions may be used in a fabric care and/or laundry care formulation comprising enzymes such as a cellulases and proteases. In another embodiment, glucan ether composition is cellulase resistant, protease resistant, amylase resistant or any combination thereof.

The α-glucan ether compositions may be used in a fabric care and/or laundry care and/or personal care compositions. In another embodiment, a personal care composition, fabric care composition or laundry care composition is provided comprising the above α-glucan ether compositions.

In another embodiment, a method for preparing an aqueous composition is provided, the method comprising: contacting an aqueous composition with the above glucan ether composition wherein the aqueous composition comprises at least one cellulase, at least one protease, at least one amylase or any combination thereof.

In another embodiment, a method of treating an article of clothing, textile or fabric is provided comprising:

a. providing a composition selected from
   i. the above fabric care composition;
   ii. the above laundry care composition;
   iii. the above glucan ether composition;
   iv. the α-glucan oligomer/polymer composition comprising:
      a. at least 75% α-(1,3) glycosidic linkages;
      b. less than 25% α-(1,6) glycosidic linkages;
      c. less than 10% α-(1,3,6) glycosidic linkages;
      d. a weight average molecular weight of less than 5000 Daltons;
      e. a viscosity of less than 0.25 Pascal second (Pa·s) at 12 wt % in water 20° C.;
      f. a solubility of at least 20% (w/w) in water at 25° C.; and
      g. a polydispersity index of less than 5; and
   v. any combination of (i) through (iv);
b. contacting under suitable conditions the composition of (a) with a fabric, textile or article of clothing whereby the fabric, textile or article of clothing is treated and receives a benefit; and
c. optionally rinsing the treated fabric, textile or article of clothing of (b).

In another embodiment of the above method, the α-glucan oligomer/polymer composition or the α-glucan ether composition is a surface substantive.

In a further embodiment of the above method, the benefit is selected from the group consisting of improved fabric hand, improved resistance to soil deposition, improved colorfastness, improved wear resistance, improved wrinkle resistance, improved antifungal activity, improved stain resistance, improved cleaning performance when laundered, improved drying rates, improved dye, pigment or lake update, and any combination thereof.

In another embodiment, a method to produce a glucan ether composition is provided comprising:

a. providing an α-glucan oligomer/polymer composition comprising:
   i. at least 75% α-(1,3) glycosidic linkages;
   ii. less than 25% α-(1,6) glycosidic linkages;
   iii. less than 10% α-(1,3,6) glycosidic linkages;
   iv. a weight average molecular weight of less than 5000 Daltons;
   v. a viscosity of less than 0.25 Pascal second (Pa·s) at 12 wt % in water 20° C.;
   vi. a solubility of at least 20% (w/w) in water at 25° C.; and
   vii. a polydispersity index of less than 5;
b. contacting the α-glucan oligomer/polymer composition of (a) in a reaction under alkaline conditions with at least one etherification agent comprising an organic group; whereby an α-glucan ether is produced has a degree of substitution (DoS) with at least one organic group of about 0.05 to about 3.0; and
c. optionally isolating the α-glucan ether produced in step (b).

A textile, yarn, fabric or fiber may be modified to comprise (e.g., blended or coated with) the above α-glucan oligomer/polymer composition or the corresponding α-glucan ether composition. In another embodiment, a textile, yarn, fabric or fiber is provided comprising:

a. an α-glucan oligomer/polymer composition comprising:
   i. at least 75% α-(1,3) glycosidic linkages;
   ii. less than 25% α-(1,6) glycosidic linkages;
   iii. less than 10% α-(1,3,6) glycosidic linkages;
   iv. a weight average molecular weight of less than 5000 Daltons;
   v. a viscosity of less than 0.25 Pascal second (Pa·s) at 12 wt % in water 20° C.;
   vi. a solubility of at least 20% (w/w) in water at 25° C.; and
   vii. a polydispersity index of less than 5;
b. a glucan ether composition comprising
   i. at least 75% α-(1,3) glycosidic linkages;
   ii. less than 25% α-(1,6) glycosidic linkages;
   iii. less than 10% α-(1,3,6) glycosidic linkages;
   iv. a weight average molecular weight of less than 5000 Daltons;
   v. a viscosity of less than 0.25 Pascal second (Pa·s) at 12 wt % in water 20° C.;
   vi. a solubility of at least 20% (w/w) in water at 25° C.; and
   vii. a polydispersity index of less than 5;
   wherein the glucan ether composition has a degree of substitution (DoS) with at least one organic group of about 0.05 to about 3.0; or
c. any combination thereof.

BRIEF DESCRIPTION OF THE BIOLOGICAL SEQUENCES

The following sequences comply with 37 C.F.R. §§ 1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (2009) and the sequence listing requirements of the European Patent Convention (EPC) and the Patent Cooperation Treaty (PCT) Rules 5.2 and 49.5(a-bis), and Section 208 and Annex C of the Administrative Instructions. The symbols and format used for nucleotide and amino acid sequence data comply with the rules set forth in 37 C.F.R. § 1.822.

SEQ ID NO: 1 is a polynucleotide sequence of a terminator sequence.

SEQ ID NO: 2 is a polynucleotide sequence of a linker sequence.

SEQ ID NO: 3 is the amino acid sequence of the *Streptococcus salivarius* Gtf-J glucosyltransferase as found in GENBANK® gi: 47527.

SEQ ID NO: 4 is the polynucleotide sequence encoding the *Streptococcus salivarius* mature Gtf-J glucosyltransferase.

SEQ ID NO: 5 is the amino acid sequence of *Streptococcus* salivarius Gtf-J mature glucosyltransferase (referred to herein as the "7527" glucosyltransferase" or "GTF7527")).

SEQ ID NO: 6 is the amino acid sequence of *Streptococcus salivarius* Gtf-L glucosyltransferase as found in GENBANK® gi: 662379.

SEQ ID NO: 7 is the nucleic acid sequence encoding a truncated *Streptococcus salivarius* Gtf-L (GENBANK® gi: 662379) glucosyltransferase.

SEQ ID NO: 8 is the amino acid sequence of a truncated *Streptococcus salivarius* Gtf-L glucosyltransferase (also referred to herein as the "2379 glucosyltransferase" or "GTF2379").

SEQ ID NO: 9 is the amino acid sequence of the *Streptococcus mutans* NN2025 Gtf-B glucosyltransferase as found in GENBANK® gi: 290580544.

SEQ ID NO: 10 is the nucleic acid sequence encoding a truncated *Streptococcus mutans* NN2025 Gtf-B (GENBANK® gi: 290580544) glucosyltransferase.

SEQ ID NO: 11 is the amino acid sequence of a truncated *Streptococcus mutans* NN2025 Gtf-B glucosyltransferase (also referred to herein as the "0544 glucosyltransferase" or "GTF0544").

SEQ ID NOs: 12-13 are the nucleic acid sequences of primers. SEQ ID NO: 14 is the amino acid sequence of the *Streptococcus sobrinus* Gtf-I glucosyltransferase as found in GENBANK® gi: 450874.

SEQ ID NO: 15 is the nucleic acid sequence encoding a truncated *Streptococcus sobrinus* Gtf-I (GENBANK® gi: 450874) glucosyltransferase.

SEQ ID NO: 16 is the amino acid sequence of a truncated *Streptococcus sobrinus* Gtf-I glucosyltransferase (also referred to herein as the "0874 glucosyltransferase" or "GTF0874").

SEQ ID NO: 17 is the amino acid sequence of the *Streptococcus* sp. C150 Gtf-S glucosyltransferase as found in GENBANK® gi: 495810459 (previously known as GENBANK® gi: 322373279)

SEQ ID NO: 18 is the nucleic acid sequence encoding a truncated *Streptococcus* sp. C150 gtf-S (GENBANK® gi: 495810459) glucosyltransferase.

SEQ ID NO: 19 is the amino acid sequence of a truncated *Streptococcus* sp. C150 Gtf-S glucosyltransferase (also referred to herein as the "0459 glucosyltransferase", "GTF0459", "3279 glucosyltransferase" or "GTF3279").

SEQ ID NO: 20 is the nucleic acid sequence encoding the *Paenibacillus humicus* mutanase (GENBANK® gi: 257153265 where GENBANK® gi: 257153264 is the corresponding polynucleotide sequence) used in Example 12 for expression in *E. coli* BL21(DE3).

SEQ ID NO: 21 is the amino acid sequence of the mature *Paenibacillus humicus* mutanase (GENBANK® gi: 257153264; referred to herein as the "3264 mutanase" or "MUT3264") used in Example 12 for expression in *E. coli* BL21(DE3).

SEQ ID NO: 22 is the amino acid sequence of the *Paenibacillus humicus* mutanase as found in GENBANK® gi: 257153264).

SEQ ID NO: 23 is the nucleic acid sequence encoding the *Paenibacillus humicus* mutanase used in Example 13 for expression in *B. subtilis* host BG6006.

SEQ ID NO: 24 is the amino acid sequence of the mature *Paenibacillus humicus* mutanase used in Example 13 for expression in *B. subtilis* host BG6006. As used herein, this mutanase may also be referred to herein as "MUT3264".

SEQ ID NO: 25 is the amino acid sequence of the *B. subtilis* AprE signal peptide used in the expression vector that was coupled to various enzymes for expression in *B. subtilis.*

SEQ ID NO: 26 is the nucleic acid sequence encoding the *Penicillium marneffei* ATCC® 18224™ mutanase.

SEQ ID NO: 27 is the amino acid sequence of the *Penicillium marneffei* ATCC® 18224™ mutanase (GENBANK® gi: 212533325; also referred to herein as the "3325 mutanase" or "MUT3325").

SEQ ID NO: 28 is the nucleic acid sequence encoding the *Aspergillus nidulans* FGSC A4 mutanase.

SEQ ID NO: 29 is the amino acid sequence of the *Aspergillus nidulans* FGSC A4 mutanase (GENBANK® gi: 259486505; also referred to herein as the "6505 mutanase" or "MUT6505").

SEQ ID NOs: 30-52 are the nucleic acid sequences of various primers used in Example 17.

SEQ ID NO: 53 is the nucleic acid sequence encoding a *Hypocrea tawa* mutanase.

SEQ ID NO: 54 is the amino acid sequence of the *Hypocrea tawa* mutanase as disclosed in U.S. Patent Appl. Pub. No. 2011-0223117A1 (also referred to herein as the "*H. tawa* mutanase").

SEQ ID NO: 55 is the nucleic acid sequence encoding the *Trichoderma konilangbra* mutanase.

SEQ ID NO: 56 is the amino acid sequence of the *Trichoderma konilangbra* mutanase as disclosed in U.S. Patent Appl. Pub. No. 2011-0223117A1 (also referred to herein as the "*T. konilangbra* mutanase").

SEQ ID NO: 57 is the nucleic acid sequence encoding the *Trichoderma reesei* RL-P37 mutanase.

SEQ ID NO: 58 is the amino acid sequence of the *Trichoderma reesei* RL-P37 mutanase as disclosed in U.S. Patent Appl. Pub. No. 2011-0223117A1 (also referred to herein as the "*T. reesei* 592 mutanase").

SEQ ID NO: 59 is the polynucleotide sequence of plasmid pTrex3. SEQ ID NO: 60 is the nucleic acid sequence encoding a truncated *Streptococcus oralis* glucosyltransferase (GENBANK® gi:7684297).

SEQ ID NO: 61 is the amino acid sequence of the truncated *Streptococcus oralis* glucosyltransferase encoded by SEQ ID NO: 60, and which is referred to herein as "GTF4297".

SEQ ID NO: 62 is the nucleic acid sequence encoding a truncated version of a *Streptococcus mutans* glucosyltransferase (GENBANK® gi:3130088).

SEQ ID NO: 63 is the amino acid sequence of the truncated *Streptococcus mutans* glucosyltransferase encoded by SEQ ID NO: 62, which is referred to herein as "GTF0088".

SEQ ID NO: 64 is the nucleic acid sequence encoding a truncated version of a *Streptococcus mutans* glucosyltransferase (GENBANK® gi:24379358).

SEQ ID NO: 65 is the amino acid sequence of the truncated *Streptococcus mutans* glucosyltransferase encoded by SEQ ID NO: 64, which is referred to herein as "GTF9358".

SEQ ID NO: 66 is the nucleic acid sequence encoding a truncated version of a *Streptococcus gallolyticus* glucosyltransferase (GENBANK® gi:32597842).

SEQ ID NO: 67 is the amino acid sequence of the truncated *Streptococcus gallolyticus* glucosyltransferase encoded by SEQ ID NO: 66, which is referred to herein as "GTF7842".

SEQ ID NO: 68 is the amino acid sequence of a *Lactobacillus reuteri* glucosyltransferase as found in GENBANK® gi:51574154.

SEQ ID NO: 69 is the nucleic acid sequence encoding a truncated version of the *Lactobacillus reuteri* glucosyltransferase (GENBANK® gi:51574154).

SEQ ID NO: 70 is the amino acid sequence of the truncated *Lactobacillus reuteri* glucosyltransferase encoded by SEQ ID NO: 69, which is referred to herein as "GTF4154".

SEQ ID NO: 71 is the amino acid sequence of a *Streptococcus downei* GTF-S glucosyltransferase as found in GENBANK® gi: 121729 (precursor with the native signal sequence) also referred to herein as "GTF1729".

SEQ ID NO: 72 is the amino acid sequence of a *Streptococcus criceti* HS-6 GTF-S glucosyltransferase as found in GENBANK® gi: 357235604 (precursor with the native signal sequence) also referred to herein as "GTF5604". The same amino acid sequence is reported under GENBANK® gi:4691428 for a glucosyltransferase from *Streptococcus criceti*. As such, this particular amino acid sequence is also referred to herein as "GTF1428".

SEQ ID NO: 73 is the amino acid sequence of a *Streptococcus criceti* HS-6 glucosyltransferase derived from GEN BANK® gi: 357236477 (also referred to herein as "GTF6477") where the native signal sequence was substituted with the AprE signal sequence for expression in *Bacillus subtilis.*

SEQ ID NO: 74 is the amino acid sequence of a *Streptococcus criceti* HS-6 glucosyltransferase derived from GEN BANK® gi: 357236477 (also referred to herein as "GTF6477-V1" or "357236477-V1") where the native signal sequence was substituted with the AprE signal sequence for expression in *Bacillus subtilis* and contains a single amino acid substitution.

SEQ ID NO: 75 is the amino acid sequence of a *Streptococcus salivarius* M18 glucosyltransferase derived from GENBANK® gi: 345526831 (also referred to herein as "GTF6831") where the native signal sequence was substituted with the AprE signal sequence for expression in *Bacillus subtilis.*

SEQ ID NO: 76 is the amino acid sequence of a *Lactobacillus* anima/is KCTC 3501 glucosyltransferase derived from GENBANK® gi: 335358117 (also referred to herein as "GTF8117") where the native signal sequence was substituted with the AprE signal sequence for expression in *Bacillus subtilis.*

SEQ ID NO: 77 is the amino acid sequence of a *Streptococcus gordonii* glucosyltransferase derived from GENBANK® gi: 1054877 (also referred to herein as "GTF4877") where the native signal sequence was substituted with the AprE signal sequence for expression in *Bacillus subtilis.*

SEQ ID NO: 78 is the amino acid sequence of a *Streptococcus sobrinus* glucosyltransferase derived from GENBANK® gi: 22138845 (also referred to herein as "GTF8845") where the native signal sequence was substituted with the AprE signal sequence for expression in *Bacillus subtilis.*

SEQ ID NO: 79 is the amino acid sequence of the *Streptococcus downei* glucosyltransferase as found in GENBANK® gi: 121724.

SEQ ID NO: 80 is the nucleic acid sequence encoding a truncated *Streptococcus downei* (GENBANK® gi: 121724) glucosyltransferase.

SEQ ID NO: 81 is the amino acid sequence of the truncated *Streptococcus downei* glucosyltransferase encoded by SEQ ID NO: 80 (also referred to herein as the "1724 glucosyltransferase" or "GTF1724").

SEQ ID NO: 82 is the amino acid sequence of the *Streptococcus dentirousetti* glucosyltransferase as found in GENBANK® gi: 167735926.

SEQ ID NO: 83 is the nucleic acid sequence encoding a truncated *Streptococcus dentirousetti* (GENBANK® gi: 167735926) glucosyltransferase.

SEQ ID NO: 84 is the amino acid sequence of the truncated *Streptococcus dentirousetti* glucosyltransferase encoded by SEQ ID NO: 83 (also referred to herein as the "5926 glucosyltransferase" or "GTF5926").

SEQ ID NO: 85 is the amino acid sequence of the dextran dextrinase (EC 2.4.1.2) expressed by a strain *Gluconobacter oxydans* referred to herein as "DDase" (see JP2007181452 (A)).

SEQ ID NO: 86 is the nucleic acid sequence encoding the GTF0459 amino acid sequence of SEQ ID NO: 19.

SEQ ID NO: 87 is the nucleic acid sequence encoding a truncated form of GTF0470, a GTF0459 homolog.

SEQ ID NO: 88 is the amino acid sequence encoded by SEQ ID NO: 87.

SEQ ID NO: 89 is the nucleic acid sequence encoding a truncated form of GTF07317, a GTF0459 homolog.

SEQ ID NO: 90 is the amino acid sequence encoded by SEQ ID NO: 89.

SEQ ID NO: 91 is the nucleic acid sequence encoding a truncated form of GTF1645, a GTF0459 homolog.

SEQ ID NO: 92 is the amino acid sequence encoded by SEQ ID NO: 91.

SEQ ID NO: 93 is the nucleic acid sequence encoding a truncated form of GTF6099, a GTF0459 homolog.

SEQ ID NO: 94 is the amino acid sequence encoded by SEQ ID NO: 93.

SEQ ID NO: 95 is the nucleic acid sequence encoding a truncated form of GTF8467, a GTF0459 homolog.

SEQ ID NO: 96 is the amino acid sequence encoded by SEQ ID NO: 95.

SEQ ID NO: 97 is the nucleic acid sequence encoding a truncated form of GTF8487, a GTF0459 homolog.

SEQ ID NO: 98 is the amino acid sequence encoded by SEQ ID NO: 97.

SEQ ID NO: 99 is the nucleic acid sequence encoding a truncated form of GTF06549, a GTF0459 homolog.

SEQ ID NO: 100 is the amino acid sequence encoded by SEQ ID NO: 99.

SEQ ID NO: 101 is the nucleic acid sequence encoding a truncated form of GTF3879, a GTF0459 homolog.

SEQ ID NO: 102 is the amino acid sequence encoded by SEQ ID NO: 101.

SEQ ID NO: 103 is the nucleic acid sequence encoding a truncated form of GTF4336, a GTF0459 homolog.

SEQ ID NO: 104 is amino acid sequence encoded by SEQ ID NO: 103.

SEQ ID NO: 105 is the nucleic acid sequence encoding a truncated form of GTF4491, a GTF0459 homolog.

SEQ ID NO: 106 is the amino acid sequence encoded by SEQ ID NO: 105.

SEQ ID NO: 107 is the nucleic acid sequence encoding a truncated form of GTF3808, a GTF0459 homolog.

SEQ ID NO: 108 is the amino acid sequence encoded by SEQ ID NO: 107.

SEQ ID NO: 109 is the nucleic acid sequence encoding a truncated form of GTF0974, a GTF0459 homolog.

SEQ ID NO: 110 is the amino acid sequence encoded by SEQ ID NO: 109.

SEQ ID NO: 111 is the nucleic acid sequence encoding a truncated form of GTF0060, a GTF0459 homolog.

SEQ ID NO: 112 is the amino acid sequence encoded by SEQ ID NO: 111.

SEQ ID NO: 113 is the nucleic acid sequence encoding a truncated form of GTF0487, a GTF0459 non-homolog.

SEQ ID NO: 114 is the amino acid sequence encoded by SEQ ID NO: 113.

SEQ ID NO: 115 is the nucleic acid sequence encoding a truncated form of GTF5360, a GTF0459 non-homolog.

SEQ ID NO: 116 is the amino acid sequence encoded by SEQ ID NO: 115.

SEQ ID NOs: 117, 119, 121, and 123 are nucleotide sequences encoding T5 C-terminal truncations of GTF0974, GTF4336, GTF4491, and GTF3808, respectively.

SEQ ID NOs: 118, 120, 122, and 124 are amino acid sequences of T5 C-terminal truncations of GTF0974, GTF4336, GTF4491, and GTF3808, respectively.

SEQ ID NO: 125 is the nucleotide sequence encoding a T5 C-terminal truncation of GTF0459.

SEQ ID NO: 126 is the amino acid sequence encoded by the nucleotide sequence of SEQ ID NO: 125.

SEQ ID NO: 127 is the nucleotide sequence encoding a T4 C-terminal truncation of GTF0974.

SEQ ID NO: 128 is the amino acid sequence encoded by the nucleotide sequence of SEQ ID NO: 127.

SEQ ID NO: 129 is the nucleotide sequence encoding a T4 C-terminal truncation of GTF4336.

SEQ ID NO: 130 is the amino acid sequence encoded by the nucleotide sequence of SEQ ID NO: 129.

SEQ ID NO: 131 is the nucleotide sequence encoding a T4 C-terminal truncation of GTF4491.

SEQ ID NO: 132 is the amino acid sequence encoded by the nucleotide sequence of SEQ ID NO: 131.

SEQ ID NO: 133 is the nucleotide sequence encoding a T6 C-terminal truncation of GTF0459.

SEQ ID NO: 134 is the amino acid sequence encoded by SEQ ID NO: 133.

SEQ ID NO: 135 is the nucleotide sequence encoding a T1 C-terminal truncation of GTF0974.

SEQ ID NO: 136 is the amino acid sequence encoded by SEQ ID NO: 135.

SEQ ID NO: 137 is the nucleotide sequence encoding a T2 C-terminal truncation of GTF0974.

SEQ ID NO: 138 is the amino acid sequence encoded by SEQ ID NO: 137.

SEQ ID NO: 139 is the nucleotide sequence encoding a T6 C-terminal truncation of GTF0974.

SEQ ID NO: 140 is the amino acid sequence encoded by SEQ ID NO: 139.

SEQ ID NO: 141 is the nucleotide sequence encoding a T1 C-terminal truncation of GTF4336.

SEQ ID NO: 142 is the amino acid sequence encoded by SEQ ID NO: 141.

SEQ ID NO: 143 is the nucleotide sequence encoding a T2 C-terminal truncation of GTF4336.

SEQ ID NO: 144 is the amino acid sequence encoded by SEQ ID NO; 143.

SEQ ID NO: 145 is the nucleotide sequence encoding a T6 C-terminal truncation of GTF4336.

SEQ ID NO: 146 is the amino acid sequence encoded by SEQ ID NO: 145.

SEQ ID NO: 147 is the nucleotide sequence encoding a T1 C-terminal truncation of GTF4991.

SEQ ID NO: 148 is the amino acid sequence encoded by SEQ ID NO: 147.

SEQ ID NO: 149 is the nucleotide sequence encoding a T2 C-terminal truncation of GTF4991.

SEQ ID NO: 150 is the amino acid sequence encoded by SEQ ID NO: 149.

SEQ ID NO: 151 is the nucleotide sequence encoding a T6 C-terminal truncation of GTF4991.

SEQ ID NO: 152 is the amino acid sequence encoded by SEQ ID NO: 151.

SEQ ID NO: 153 is an amino acid consensus sequence based on the alignment of GTF0459 and its identified homologs.

DETAILED DESCRIPTION

In this disclosure, a number of terms and abbreviations are used. The following definitions apply unless specifically stated otherwise.

As used herein, the articles "a", "an", and "the" preceding an element or component are intended to be nonrestrictive regarding the number of instances (i.e., occurrences) of the element or component. Therefore "a", "an", and "the" should be read to include one or at least one, and the singular word form of the element or component also includes the plural unless the number is obviously meant to be singular.

As used herein, the term "comprising" means the presence of the stated features, integers, steps, or components as referred to in the claims, but that it does not preclude the presence or addition of one or more other features, integers, steps, components or groups thereof. The term "comprising" is intended to include embodiments encompassed by the terms "consisting essentially of" and "consisting of". Similarly, the term "consisting essentially of" is intended to include embodiments encompassed by the term "consisting of".

As used herein, the term "about" modifying the quantity of an ingredient or reactant employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities.

Where present, all ranges are inclusive and combinable. For example, when a range of "1 to 5" is recited, the recited range should be construed as including ranges "1 to 4", "1 to 3", "1-2", "1-2 & 4-5", "1-3 & 5", and the like.

As used herein, the term "obtainable from" shall mean that the source material (for example, sucrose) is capable of being obtained from a specified source, but is not necessarily limited to that specified source.

As used herein, the term "effective amount" will refer to the amount of the substance used or administered that is suitable to achieve the desired effect. The effective amount of material may vary depending upon the application. One of skill in the art will typically be able to determine an effective amount for a particular application or subject without undo experimentation.

As used herein, the term "isolated" means a substance in a form or environment that does not occur in nature. Non-limiting examples of isolated substances include (1) any non-naturally occurring substance, (2) any substance including, but not limited to, any host cell, enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated.

The terms "percent by volume", "volume percent", "vol %" and "v/v %" are used interchangeably herein. The percent by volume of a solute in a solution can be determined using the formula: [(volume of solute)/(volume of solution)]×100%.

The terms "percent by weight", "weight percentage (wt %)" and "weight-weight percentage (% w/w)" are used interchangeably herein. Percent by weight refers to the percentage of a material on a mass basis as it is comprised in a composition, mixture, or solution.

The terms "increased", "enhanced" and "improved" are used interchangeably herein. These terms refer to a greater quantity or activity such as a quantity or activity slightly greater than the original quantity or activity, or a quantity or activity in large excess compared to the original quantity or activity, and including all quantities or activities in between. Alternatively, these terms may refer to, for example, a quantity or activity that is at least 1%, 2%, 3%, 4%, 5%, 6%, 7%, 8%, 9%, 10%, 11%, 12%, 13%, 14%, 15%, 16%, 17%, 18%, 19% or 20% more than the quantity or activity for which the increased quantity or activity is being compared.

As used herein, the term "isolated" means a substance in a form or environment that does not occur in nature. Non-limiting examples of isolated substances include (1) any non-naturally occurring substance, (2) any substance including, but not limited to, any host cell, enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated.

As used herein, term "water soluble" will refer to the present glucan oligomer/polymer compositions that are soluble at 20 wt % or higher in pH 7 water at 25° C.

As used herein, the terms "soluble glucan fiber", "α-glucan fiber", "α-glucan polymer", "α-glucan oligosaccharide", "α-glucan polysaccharide", "α-glucan oligomer", "α-glucan oligomer/polymer", "α-glucan polymer", and "soluble glucan fiber composition" refer to the present α-glucan polymer composition (non-derivatized; i.e., not an α-glucan ether) comprised of water soluble glucose oligomers having a glucose polymerization degree of 3 or more. The present soluble glucan polymer composition is enzymatically synthesized from sucrose (α-D-Glucopyranosyl β-D-fructofuranoside; CAS #57-50-1) obtainable from, for example, sugarcane and/or sugar beets. In one embodiment, the present soluble α-glucan polymer composition is not alternan or maltoalternan oligosaccharide.

As used herein, "weight average molecular weight" or "$M_w$" is calculated as $M_w = \Sigma N_i M_i^2 / \Sigma N_i M_i$; where $M_i$ is the molecular weight of a chain and $N_i$ is the number of chains of that molecular weight. The weight average molecular weight can be determined by technics such as static light scattering, small angle neutron scattering, X-ray scattering, and sedimentation velocity.

As used herein, "number average molecular weight" or "$M_n$" refers to the statistical average molecular weight of all the polymer chains in a sample. The number average molecular weight is calculated as $M_n = \Sigma N_i M_i / \Sigma N_i$ where $M_i$ is the molecular weight of a chain and $N_i$ is the number of chains of that molecular weight. The number average molecular weight of a polymer can be determined by technics such as gel permeation chromatography, viscometry via the (Mark-Houwink equation), and colligative methods such as vapor pressure osmometry, end-group determination or proton NMR.

As used herein, "polydispersity index", "PDI", "heterogeneity index", and "dispersity" refer to a measure of the distribution of molecular mass in a given polymer (such as a glucose oligomer) sample and can be calculated by dividing the weight average molecular weight by the number average molecular weight (PDI=$M_w/M_n$).

It shall be noted that the terms "glucose" and "glucopyranose" as used herein are considered as synonyms and used interchangeably. Similarly the terms "glucosyl" and "glucopyranosyl" units are used herein are considered as synonyms and used interchangeably.

As used herein, "glycosidic linkages" or "glycosidic bonds" will refer to the covalent the bonds connecting the sugar monomers within a saccharide oligomer (oligosaccharides and/or polysaccharides). Example of glycosidic linkage may include α-linked glucose oligomers with 1,6-α-D-glycosidic linkages (herein also referred to as α-D-(1,6) linkages or simply "α-(1,6)" linkages); 1,3-α-D-glycosidic linkages (herein also referred to as α-D-(1,3) linkages or simply "α-(1,3)" linkages; 1,4-α-D-glycosidic linkages (herein also referred to as α-D-(1,4) linkages or simply "α-(1,4)" linkages; 1,2-α-D-glycosidic linkages (herein also referred to as α-D-(1,2) linkages or simply "α-(1,2)" linkages; and combinations of such linkages typically associated with branched saccharide oligomers.

As used herein, the terms "glucansucrase", "glucosyltransferase", "glucoside hydrolase type 70", "GTF", and "GS" will refer to transglucosidases classified into family 70 of the glycoside-hydrolases typically found in lactic acid bacteria such as *Streptococcus, Leuconostoc*, Weisella or *Lactobacillus* genera (see Carbohydrate Active Enzymes database; "CAZy"; Cantarel et al., (2009) *Nucleic Acids Res* 37:D233-238). The GTF enzymes are able to polymerize the D-glucosyl units of sucrose to form homooligosaccharides or horn opolysaccharides. Glucosyltransferases can be identified by characteristic structural features such as those described in Leemhuis et al. (*J. Biotechnology* (2013) 162: 250-272) and Monchois et al. (*FEMS Micro. Revs*. (1999) 23:131-151). Depending upon the specificity of the GTF enzyme, linear and/or branched glucans comprising various glycosidic linkages may be formed such as α-(1,2), α-(1,3), α-(1,4) and α-(1,6). Glucosyltransferases may also transfer the D-glucosyl units onto hydroxyl acceptor groups. A non-limiting list of acceptors include carbohydrates, alcohols, polyols or flavonoids. Specific acceptors may also include maltose, isomaltose, isomaltotriose, and methyl-α-D-glucan. The structure of the resultant glucosylated product is dependent upon the enzyme specificity. A non-limiting list of glucosyltransferase sequences is provided as amino acid SEQ ID NOs: 3, 5, 6, 8, 9, 11, 14, 16, 17, 19, 61, 63, 65, 67, 68, 70, 72, 73, 74, 75, 76, 77, 78, 79, 81, 82, 84, 88, 90, 92, 94, 96, 98, 100, 102, 104, 106, 108, 110, and 112. In one aspect, the glucosyltransferase is expressed in a truncated and/or mature form. Non-limiting examples of truncated glucosyltransferase amino acid sequences include SEQ ID NOs: 118, 120, 122, 124, 126, 128, 130, 132, 134, 136, 138, 140, 142, 144, 146, 148, 150, and 152.

As used herein, the term "isomaltooligosaccharide" or "IMO" refers to a glucose oligomers comprised essentially of α-D-(1,6) glycosidic linkage typically having an average size of DP 2 to 20. Isomaltooligosaccharides can be produced commercially from an enzymatic reaction of α-amylase, pullulanase, β-amylase, and α-glucosidase upon corn starch or starch derivative products. Commercially available products comprise a mixture of isomaltooligosaccharides (DP ranging from 3 to 8, e.g., isomaltotriose, isomaltotetraose, isomaltopentaose, isomaltohexaose, isomaltoheptaose, isomaltooctaose) and may also include panose.

As used herein, the term "dextran" refers to water soluble α-glucans comprising at least 95% α-D-(1,6) glycosidic linkages (typically with up to 5% α-D-(1,3) glycosidic linkages at branching points). Dextrans often have an average molecular weight above 1000 kDa. As used herein, enzymes capable of synthesizing dextran from sucrose may be described as "dextransucrases" (EC 2.4.1.5).

As used herein, the term "mutan" refers to water insoluble α-glucans comprised primarily (50% or more of the glycosidic linkages present) of 1,3-α-D glycosidic linkages and typically have a degree of polymerization (DP) that is often greater than 9. Enzymes capable of synthesizing mutan or α-glucan oligomers comprising greater than 50% 1,3-α-D glycosidic linkages from sucrose may be described as "mutansucrases" (EC 2.4.1.-) with the proviso that the enzyme does not produce alternan.

As used herein, the term "alternan" refers to α-glucans having alternating 1,3-α-D glycosidic linkages and 1,6-α-D glycosidic linkages over at least 50% of the linear oligosaccharide backbone. Enzymes capable of synthesizing alternan from sucrose may be described as "alternansucrases" (EC 2.4.1.140).

As used herein, the term "reuteran" refers to soluble α-glucan comprised 1,4-α-D-glycosidic linkages (typically >50%); 1,6-α-D-glycosidic linkages; and 4,6-disubstituted α-glucosyl units at the branching points. Enzymes capable of synthesizing reuteran from sucrose may be described as "reuteransucrases" (EC 2.4.1.-).

As used herein, the terms "α-glucanohydrolase" and "glucanohydrolase" will refer to an enzyme capable of hydrolyzing an α-glucan oligomer. As used herein, the glucanohydrolase may be defined by the endohydrolysis activity towards certain α-D-glycosidic linkages. Examples may include, but are not limited to, dextranases (EC 3.2.1.11; capable of endohydrolyzing α-(1,6)-linked glycosidic bonds), mutanases (EC 3.2.1.59; capable of endohydrolyzing α-(1,3)-linked glycosidic bonds), and alternanases (EC 3.2.1.-; capable of endohydrolytically cleaving alternan). Various factors including, but not limited to, level of branching, the type of branching, and the relative branch length within certain α-glucans may adversely impact the ability of an α-glucanohydrolase to endohydrolyze some glycosidic linkages.

As used herein, the term "dextranase" (α-1,6-glucan-6-glucanohydrolase; EC 3.2.1.11) refers to an enzyme capable of endohydrolysis of 1,6-α-D-glycosidic linkages (the linkage predominantly found in dextran). Dextranases are known to be useful for a number of applications including the use as ingredient in dentifrice for prevention of dental caries, plaque and/or tartar and for hydrolysis of raw sugar juice or syrup of sugar canes and sugar beets. Several microorganisms are known to be capable of producing dextranases, among them fungi of the genera *Penicillium, Paecilomyces, Aspergillus, Fusarium, Spicaria, Verticillium, Helminthosporium* and *Chaetomium*; bacteria of the genera *Lactobacillus, Streptococcus, Cellvibrio, Cytophaga, Brevibacterium, Pseudomonas, Corynebacterium, Arthrobacter* and *Flavobacterium*, and yeasts such as *Lipomyces starkeyi*. Food grade dextranases are commercially available. An example of a food grade dextrinase is DEXTRANASE® Plus L, an enzyme from *Chaetomium erraticum* sold by Novozymes A/S, Bagsvaerd, Denmark.

As used herein, the term "mutanase" (glucan endo-1,3-α-glucosidase; EC 3.2.1.59) refers to an enzyme which hydrolytically cleaves 1,3-α-D-glycosidic linkages (the linkage predominantly found in mutan). Mutanases are available from a variety of bacterial and fungal sources. A non-limiting list of mutanases is provided as amino acid sequences 21, 22, 24, 27, 29, 54, 56, and 58.

As used herein, the term "alternanase" (EC 3.2.1.-) refers to an enzyme which endo-hydrolytically cleaves alternan (U.S. Pat. No. 5,786,196 to Cote et al.).

As used herein, the term "wild type enzyme" will refer to an enzyme (full length and active truncated forms thereof) comprising the amino acid sequence as found in the organism from which it was obtained and/or annotated. The enzyme (full length or catalytically active truncation thereof) may be recombinantly produced in a microbial host cell. The enzyme is typically purified prior to being used as a processing aid in the production of the present soluble α-glucan oligomer/polymer composition. In one aspect, a combination of at least two wild type enzymes simultaneously present in the reaction system is used in order to obtain the present α-glucan polymer composition. In another aspect, under certain reaction conditions (for example, a reaction temperature around 47° C. to 50° C.) it may be possible to use a single wild type glucosyltransferase to produce the present soluble α-glucan polymer (see Examples 37 and 41). In another aspect, the present method comprises a single reaction chamber comprising at least one glucosyltransferase capable of forming a soluble α-glucan polymer composition comprising 50% or more α-(1,3) glycosidic linkages (such as a mutansucrase) and at least one α-glucanohydrolase having endohydrolysis activity for the α-glucan synthesized from the glucosyltransferase(s) present in the reaction system.

As used herein, the terms "substrate" and "suitable substrate" will refer to a composition comprising sucrose. In one embodiment, the substrate composition may further comprise one or more suitable acceptors, such as maltose, isomaltose, isomaltotriose, and methyl-α-D-glucan, to name a few. In one embodiment, a combination of at least one glucosyltransferase capable for forming glucose oligomers is used in combination with at least one α-glucanohydrolase in the same reaction mixture (i.e., they are simultaneously present and active in the reaction mixture). As such the "substrate" for the α-glucanohydrolase is the glucose oligomers concomitantly being synthesized in the reaction system by the glucosyltransferase from sucrose. In one aspect, a two-enzyme method (i.e., at least one glucosyltransferase (GTF) and at least one α-glucanohydrolase) where the enzymes are not used concomitantly in the reaction mixture is excluded, by proviso, from the present methods.

As used herein, the terms "suitable enzymatic reaction mixture", "suitable reaction components", "suitable aqueous reaction mixture", and "reaction mixture", refer to the materials (suitable substrate(s)) and water in which the reactants come into contact with the enzyme(s). The suitable reaction components may be comprised of a plurality of enzymes. In one aspect, the suitable reaction components comprises at least one glucansucrase enzyme. In a further aspect, the suitable reaction components comprise at least one glucansucrase and at least one α-glucanohydrolase.

As used herein, "one unit of glucansucrase activity" or "one unit of glucosyltransferase activity" is defined as the amount of enzyme required to convert 1 μmol of sucrose per minute when incubated with 200 g/L sucrose at pH 5.5 and 37° C. The sucrose concentration was determined using HPLC.

As used herein, "one unit of dextranase activity" is defined as the amount of enzyme that forms 1 μmol reducing sugar per minute when incubated with 0.5 mg/mL dextran substrate at pH 5.5 and 37° C. The reducing sugars were determined using the PAHBAH assay (Lever M., (1972), A New Reaction for Colorimetric Determination of Carbohydrates, *Anal. Biochem.* 47, 273-279).

As used herein, "one unit of mutanase activity" is defined as the amount of enzyme that forms 1 μmol reducing sugar per minute when incubated with 0.5 mg/mL mutan substrate at pH 5.5 and 37° C. The reducing sugars were determined using the PAHBAH assay (Lever M., supra).

As used herein, the term "enzyme catalyst" refers to a catalyst comprising an enzyme or combination of enzymes having the necessary activity to obtain the desired soluble α-glucan polymer composition. In certain embodiments, a combination of enzyme catalysts may be required to obtain the desired soluble glucan polymer composition. The enzyme catalyst(s) may be in the form of a whole microbial cell, permeabilized microbial cell(s), one or more cell components of a microbial cell extract(s), partially purified enzyme(s) or purified enzyme(s). In certain embodiments the enzyme catalyst(s) may also be chemically modified (such as by pegylation or by reaction with cross-linking reagents). The enzyme catalyst(s) may also be immobilized on a soluble or insoluble support using methods well-known to those skilled in the art; see for example, *Immobilization of Enzymes and Cells*; Gordon F. Bickerstaff, Editor; Humana Press, Totowa, NJ, USA; 1997.

The term "resistance to enzymatic hydrolysis" will refer to the relative stability of the present materials (α-glucan oligomers/polymers and/or the corresponding α-glucan ether compounds produced by the etherification of the present α-glucan oligomers/polymers) to enzymatic hydrolysis. The resistance to hydrolysis will be particular important for use of the present materials in applications wherein enzymes are often present, such as in fabric care and laundry care applications. In one embodiment, the α-glucan oligomers/polymers and/or the corresponding α-glucan ether compounds produced by the etherification of the present α-glucan oligomers/polymers are resistant to cellulases (i.e., cellulase resistant). In another embodiment, the α-glucan oligomers/polymers and/or the corresponding α-glucan ether compounds produced by the etherification of the present α-glucan oligomers/polymers are resistant to proteases (i.e., protease resistant). In another embodiment, the α-glucan oligomers/polymers and/or the corresponding α-glucan ether compounds produced by the etherification of the present α-glucan oligomers/polymers are resistant to amylases (i.e., amylase resistant). In a preferred aspect, α-glucan oligomers/polymers and/or the corresponding α-glucan ether compounds produced by the etherification of the present α-glucan oligomers/polymers are resistant to multiple classes of enzymes (combinations of cellulases, proteases, and/or amylases). Resistance to any particular enzyme will be defined as having at least 50%, preferably at least 60, 70, 80, 90, 95 or 100% of the materials remaining after treatment with the respective enzyme. The % remaining may be determined by measuring the supernatant after enzyme treatment using SEC-HPLC. The assay to measure enzyme resistance may using the following: A sample of the soluble material (e.g., 100 mg to is added to 10.0 mL water in a 20-mL scintillation vial and mixed using a PTFE magnetic stir bar to create a 1 wt % solution. The reaction is run at pH 7.0 at 20° C. After the fiber is complete dissolved, 1.0 mL (1 wt % enzyme formulation) of cellulase (PURADEX® EGL), amylase (PURASTAR® ST L) or protease (SAVINASE® 16.0 L) is added and the solution is mixed for 72 hrs at 20° C. The reaction mixture is heated to 70° C. for 10 minutes to inactivate the added enzyme, and the resulting mixture is cooled to room temperature and centrifuged to remove any precipitate. The supernatant is analyzed by SEC-HPLC for recovered oligomers/polymers and compared to a control where no enzyme was added to the reaction mixture. Percent changes in area counts for the respective oligomers/polymers may be used to test the relative resistance of the materials to the respective enzyme treatment. Percent changes in area count for total ≥DP3$^+$ fibers will be used to assess the relative amount of materials remaining after treatment with a particular enzyme. Materials having a percent recovery of at least 50%, preferably at least 60, 70, 80, 90, 95 or 100% will be considered "resistant" to the respective enzyme treatment (e.g., "cellulase resistant", "protease resistant" and/or "amylase resistant").

The terms "α-glucan ether compound", "α-glucan ether composition", "α-glucan ether", and "α-glucan ether derivative" are used interchangeably herein. An α-glucan ether compound herein is the present α-glucan polymer that has been etherified with one or more organic groups such that the compound has a degree of substitution (DoS) with one or more organic groups of about 0.05 to about 3.0. Such etherification occurs at one or more hydroxyl groups of at least 30% of the glucose monomeric units of the α-glucan polymer.

An α-glucan ether compound is termed an "ether" herein by virtue of comprising the substructure —$C_G$—O—C—, where "—$C_G$—" represents a carbon atom of a glucose monomeric unit of an α-glucan ether compound (where such carbon atom was bonded to a hydroxyl group [—OH] in the α-glucan polymer precursor of the ether), and where "—C—" is a carbon atom of the organic group. Thus, for example, with regard to a glucose monomeric unit (G) involved in -1,3-G-1,3- within an ether herein, CG atoms 2, 4 and/or 6 of the glucose (G) may independently be linked to an OH group or be in ether linkage to an organic group. Similarly, for example, with regard to a glucose monomeric unit (G) involved in -1,3-G-1,6- within an ether herein, CG atoms 2, 4 and/or 6 of the glucose (G) may independently be linked to an OH group or be in ether linkage to an organic group. Also, for example, with regard to a glucose monomeric unit (G) involved in -1,6-G-1,6- within an ether herein, CG atoms 2, 3 and/or 4 of the glucose (G) may independently be linked to an OH group or be in ether linkage to an organic group. Similarly, for example, with regard to a glucose monomeric unit (G) involved in -1,6-G-1,3- within an ether herein, $C_G$ atoms 2, 3 and/or 4 of the glucose (G) may independently be linked to an OH group or be in ether linkage to an organic group.

It would be understood that a "glucose" monomeric unit of an α-glucan ether compound herein typically has one or more organic groups in ether linkage. Thus, such a glucose monomeric unit can also be referred to as an etherized glucose monomeric unit.

The α-glucan ether compounds disclosed herein are synthetic, man-made compounds. Likewise, compositions comprising the present α-glucan polymer are synthetic, man-made compounds.

An "organic group" group as used herein can refer to a chain of one or more carbons that (i) has the formula —$C_nH_{2n+1}$ (i.e., an alkyl group, which is completely saturated) or (ii) is mostly saturated but has one or more hydrogens substituted with another atom or functional group (i.e., a "substituted alkyl group"). Such substitution may be with one or more hydroxyl groups, oxygen atoms (thereby forming an aldehyde or ketone group), carboxyl groups, or other alkyl groups. Thus, as examples, an organic group herein can be an alkyl group, carboxy alkyl group, or hydroxy alkyl group. An organic group herein may thus be uncharged or anionic (an example of an anionic organic group is a carboxy alkyl group).

A "carboxy alkyl" group herein refers to a substituted alkyl group in which one or more hydrogen atoms of the alkyl group are substituted with a carboxyl group. A "hydroxy alkyl" group herein refers to a substituted alkyl group in which one or more hydrogen atoms of the alkyl group are substituted with a hydroxyl group.

The phrase "positively charged organic group" as used herein refers to a chain of one or more carbons ("carbon chain") that has one or more hydrogens substituted with another atom or functional group (i.e., a "substituted alkyl group"), where one or more of the substitutions is with a positively charged group. Where a positively charged organic group has a substitution in addition to a substitution with a positively charged group, such additional substitution may be with one or more hydroxyl groups, oxygen atoms (thereby forming an aldehyde or ketone group), alkyl groups, and/or additional positively charged groups. A positively charged organic group has a net positive charge since it comprises one or more positively charged groups.

The terms "positively charged group", "positively charged ionic group" and "cationic group" are used interchangeably herein. A positively charged group comprises a cation (a positively charged ion). Examples of positively charged groups include substituted ammonium groups, carbocation groups and acyl cation groups.

A composition that is "positively charged" herein is repelled from other positively charged substances, but attracted to negatively charged substances.

The terms "substituted ammonium group", "substituted ammonium ion" and "substituted ammonium cation" are used interchangeably herein. A substituted ammonium group herein comprises structure I:

(I)

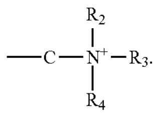

$R_2$, $R_3$ and $R_4$ in structure I each independently represent a hydrogen atom or an alkyl, aryl, cycloalkyl, aralkyl, or alkaryl group. The carbon atom (C) in structure I is part of the chain of one or more carbons ("carbon chain") of the positively charged organic group. The carbon atom is either directly ether-linked to a glucose monomer of the α-glucan polymer, or is part of a chain of two or more carbon atoms ether-linked to a glucose monomer of the α-glucan polymer/oligomer. The carbon atom in structure I can be —$CH_2$—, —CH— (where a H is substituted with another group such as a hydroxy group), or —C— (where both H's are substituted).

A substituted ammonium group can be a "primary ammonium group", "secondary ammonium group", "tertiary ammonium group", or "quaternary ammonium" group, depending on the composition of $R_2$, $R_3$ and $R_4$ in structure I. A primary ammonium group herein refers to structure I in which each of $R_2$, $R_3$ and $R_4$ is a hydrogen atom (i.e., —C—$NH_3^+$). A secondary ammonium group herein refers to structure I in which each of $R_2$ and $R_3$ is a hydrogen atom and $R_4$ is an alkyl, aryl, or cycloalkyl group. A tertiary ammonium group herein refers to structure I in which $R_2$ is a hydrogen atom and each of $R_3$ and $R_4$ is an alkyl, aryl, or cycloalkyl group. A quaternary ammonium group herein refers to structure I in which each of $R_2$, $R_3$ and $R_4$ is an alkyl, aryl, or cycloalkyl group (i.e., none of $R_2$, $R_3$ and $R_4$ is a hydrogen atom).

A quaternary ammonium α-glucan ether herein can comprise a trialkyl ammonium group (where each of $R_2$, $R_3$ and $R_4$ is an alkyl group), for example. A trimethylammonium group is an example of a trialkyl ammonium group, where each of $R_2$, $R_3$ and $R_4$ is a methyl group. It would be understood that a fourth member (i.e., $R_1$) implied by "quaternary" in this nomenclature is the chain of one or more carbons of the positively charged organic group that is ether-linked to a glucose monomer of the present α-glucan polymer/oligomer.

An example of a quaternary ammonium α-glucan ether compound is trimethylammonium hydroxypropyl α-glucan. The positively charged organic group of this ether compound can be represented as structure II:

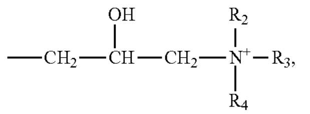

(II)

where each of $R_2$, $R_3$ and $R_4$ is a methyl group. Structure II is an example of a quaternary ammonium hydroxypropyl group.

A "halide" herein refers to a compound comprising one or more halogen atoms (e.g., fluorine, chlorine, bromine, iodine). A halide herein can refer to a compound comprising one or more halide groups such as fluoride, chloride, bromide, or iodide. A halide group may serve as a reactive group of an etherification agent.

When referring to the non-enzymatic etherification reaction, the terms "reaction", "reaction composition", and "etherification reaction" are used interchangeably herein and refer to a reaction comprising at least α-glucan polymer and an etherification agent. These components are typically mixed (e.g., resulting in a slurry) and/or dissolved in a solvent (organic and/or aqueous) comprising alkali hydroxide. A reaction is placed under suitable conditions (e.g., time, temperature) for the etherification agent to etherify one or more hydroxyl groups of the glucose units of α-glucan polymer/oligomer with an organic group, thereby yielding an α-glucan ether compound.

The term "alkaline conditions" herein refers to a solution or mixture pH of at least 10, 11 or 12. Alkaline conditions can be prepared by any means known in the art, such as by dissolving an alkali hydroxide in a solution or mixture.

The terms "etherification agent" and "alkylation agent" are used interchangeably herein. An etherification agent herein refers to an agent that can be used to etherify one or more hydroxyl groups of one or more glucose units of the present α-glucan polymer/oligomer with an organic group. An etherification agent thus comprises an organic group.

The term "degree of substitution" (DoS) as used herein refers to the average number of hydroxyl groups substituted in each monomeric unit (glucose) of the present α-glucan ether compound. Since there are at most three hydroxyl groups in a glucose monomeric unit in an α-glucan polymer/oligomer, the degree of substitution in an α-glucan ether compound herein can be no higher than 3.

The term "molar substitution" (M.S.) as used herein refers to the moles of an organic group per monomeric unit of the present α-glucan ether compound. Alternatively, M.S. can refer to the average moles of etherification agent used to react with each monomeric unit in the present α-glucan oligomer/polymer (M.S. can thus describe the degree of derivatization with an etherification agent). It is noted that the M.S. value for the present α-glucan may have no upper limit. For example, when an organic group containing a hydroxyl group (e.g., hydroxyethyl or hydroxypropyl) has been etherified to α-glucan, the hydroxyl group of the organic group may undergo further reaction, thereby coupling more of the organic group to the α-glucan oligomer/polymer.

The term "crosslink" herein refers to a chemical bond, atom, or group of atoms that connects two adjacent atoms in one or more polymer molecules. It should be understood that, in a composition comprising crosslinked α-glucan ether, crosslinks can be between at least two α-glucan ether molecules (i.e., intermolecular crosslinks); there can also be intramolecular crosslinking. A "crosslinking agent" as used herein is an atom or compound that can create crosslinks.

An "aqueous composition" herein refers to a solution or mixture in which the solvent is at least about 20 wt % water, for example, and which comprises the present α-glucan oligomer/polymer and/or the present α-glucan ether compound derivable from etherification of the present α-glucan oligomer/polymer. Examples of aqueous compositions herein are aqueous solutions and hydrocolloids.

The terms "hydrocolloid" and "hydrogel" are used interchangeably herein. A hydrocolloid refers to a colloid system in which water is the dispersion medium. A "colloid" herein refers to a substance that is microscopically dispersed throughout another substance. Therefore, a hydrocolloid herein can also refer to a dispersion, emulsion, mixture, or solution of α-glucan oligomer/polymer and/or one or more α-glucan ether compounds in water or aqueous solution.

The term "aqueous solution" herein refers to a solution in which the solvent is water. The present α-glucan oligomer/polymer and/or the present α-glucan ether compounds can be dispersed, mixed, and/or dissolved in an aqueous solution. An aqueous solution can serve as the dispersion medium of a hydrocolloid herein.

The terms "dispersant" and "dispersion agent" are used interchangeably herein to refer to a material that promotes the formation and stabilization of a dispersion of one substance in another. A "dispersion" herein refers to an aqueous composition comprising one or more particles (e.g., any ingredient of a personal care product, pharmaceutical product, food product, household product, or industrial product disclosed herein) that are scattered, or uniformly scattered, throughout the aqueous composition. It is believed that the present α-glucan oligomer/polymer and/or the present α-glucan ether compounds can act as dispersants in aqueous compositions disclosed herein.

The term "viscosity" as used herein refers to the measure of the extent to which a fluid or an aqueous composition such as a hydrocolloid resists a force tending to cause it to flow. Various units of viscosity that can be used herein include centipoise (cPs) and Pascal-second (Pa·s). A centipoise is one one-hundredth of a poise; one poise is equal to $0.100\ kg \cdot m^{-1} \cdot s^{-1}$. Thus, the terms "viscosity modifier" and "viscosity-modifying agent" as used herein refer to anything that can alter/modify the viscosity of a fluid or aqueous composition.

The term "shear thinning behavior" as used herein refers to a decrease in the viscosity of the hydrocolloid or aqueous solution as shear rate increases. The term "shear thickening behavior" as used herein refers to an increase in the viscosity of the hydrocolloid or aqueous solution as shear rate increases. "Shear rate" herein refers to the rate at which a progressive shearing deformation is applied to the hydrocolloid or aqueous solution. A shearing deformation can be applied rotationally.

The term "contacting" as used herein with respect to methods of altering the viscosity of an aqueous composition refers to any action that results in bringing together an aqueous composition with the present α-glucan polymer composition and/or α-glucan ether compound. "Contacting" may also be used herein with respect to treating a fabric, textile, yarn or fiber with the present α-glucan polymer and/or α-glucan ether compound to provide a surface substantive effect. Contacting can be performed by any means known in the art, such as dissolving, mixing, shaking, homogenization, spraying, treating, immersing, flushing, pouring on or in, combining, painting, coating, applying, affixing to and otherwise communicating an effective amount of the α-glucan polymer composition and/or α-glucan ether compound to an aqueous composition and/or directly to a fabric, fiber, yarn or textile to achieve the desired effect.

The terms "fabric", "textile", and "cloth" are used interchangeably herein to refer to a woven or non-woven material having a network of natural and/or artificial fibers. Such fibers can be thread or yarn, for example.

A "fabric care composition" herein is any composition suitable for treating fabric in some manner. Examples of such a composition include non-laundering fiber treatments (for desizing, scouring, mercerizing, bleaching, coloration, dying, printing, bio-polishing, anti-microbial treatments, anti-wrinkle treatments, stain resistance treatments, etc.), laundry care compositions (e.g., laundry care detergents), and fabric softeners.

The terms "heavy duty detergent" and "all-purpose detergent" are used interchangeably herein to refer to a detergent useful for regular washing of white and colored textiles at any temperature. The terms "low duty detergent" or "fine fabric detergent" are used interchangeably herein to refer to a detergent useful for the care of delicate fabrics such as viscose, wool, silk, microfiber or other fabric requiring special care. "Special care" can include conditions of using excess water, low agitation, and/or no bleach, for example.

The term "adsorption" herein refers to the adhesion of a compound (e.g., the present α-glucan polymer/oligomer and/or the present α-glucan ether compounds derived from the present α-glucan polymer/oligomers) to the surface of a material.

The terms "cellulase" and "cellulase enzyme" are used interchangeably herein to refer to an enzyme that hydrolyzes β-1,4-D-glucosidic linkages in cellulose, thereby partially or completely degrading cellulose. Cellulase can alternatively be referred to as "β-1,4-glucanase", for example, and can have endocellulase activity (EC 3.2.1.4), exocellulase activity (EC 3.2.1.91), or cellobiase activity (EC 3.2.1.21). A cellulase in certain embodiments herein can also hydrolyze β-1,4-D-glucosidic linkages in cellulose ether derivatives such as carboxymethyl cellulose. "Cellulose" refers to an insoluble polysaccharide having a linear chain of β-1,4-linked D-glucose monomeric units.

As used herein, the term "fabric hand" or "handle" is meant people's tactile sensory response towards fabric which may be physical, physiological, psychological, social or any combination thereof. In one embodiment, the fabric hand may be measured using a PhabrOmeter® System for measuring relative hand value (available from Nu Cybertek, Inc. Davis, CA) (American Association of Textile Chemists and Colorists (AATCC test method "202-2012, Relative Hand Value of Textiles: Instrumental Method").

As used herein, "pharmaceutically-acceptable" means that the compounds or compositions in question are suitable for use in contact with the tissues of humans and other animals without undue toxicity, incompatibility, instability, irritation, allergic response, and the like, commensurate with a reasonable benefit/risk ratio.

As used herein, the term "oligosaccharide" refers to polymers typically containing between 3 and about 30 monosaccharide units linked by α-glycosidic bonds.

As used herein the term "polysaccharide" refers to polymers typically containing greater than 30 monosaccharide units linked by α-glycosidic bonds.

As used herein, "personal care products" means products used in the cosmetic treatment hair, skin, scalp, and teeth, including, but not limited to shampoos, body lotions, shower gels, topical moisturizers, toothpaste, tooth gels, mouthwashes, mouthrinses, anti-plaque rinses, and/or other topical treatments. In some particularly preferred embodiments, these products are utilized on humans, while in other embodiments, these products find cosmetic use with non-human animals (e.g., in certain veterinary applications).

As used herein, an "isolated nucleic acid molecule", "isolated polynucleotide", and "isolated nucleic acid fragment" will be used interchangeably and refer to a polymer of RNA or DNA that is single- or double-stranded, optionally containing synthetic, non-natural or altered nucleotide bases. An isolated nucleic acid molecule in the form of a polymer of DNA may be comprised of one or more segments of cDNA, genomic DNA or synthetic DNA.

The term "amino acid" refers to the basic chemical structural unit of a protein or polypeptide. The following abbreviations are used herein to identify specific amino acids:

| Amino Acid | Three-Letter Abbreviation | One-Letter Abbreviation |
|---|---|---|
| Alanine | Ala | A |
| Arginine | Arg | R |
| Asparagine | Asn | N |
| Aspartic acid | Asp | D |
| Cysteine | Cys | C |
| Glutamine | Gln | Q |
| Glutamic acid | Glu | E |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |
| Any amino acid or as defined herein | Xaa | X |

It would be recognized by one of ordinary skill in the art that modifications of amino acid sequences disclosed herein can be made while retaining the function associated with the disclosed amino acid sequences. For example, it is well known in the art that alterations in a gene which result in the production of a chemically equivalent amino acid at a given site, but do not affect the functional properties of the encoded protein are common. For the purposes of the present disclosure, substitutions are defined as exchanges within one of the following five groups:

1. Small aliphatic, nonpolar or slightly polar residues: Ala, Ser, Thr (Pro, Gly);
2. Polar, negatively charged residues and their amides: Asp, Asn, Glu, Gln;
3. Polar, positively charged residues: His, Arg, Lys;
4. Large aliphatic, nonpolar residues: Met, Leu, Ile, Val (Cys); and
5. Large aromatic residues: Phe, Tyr, and Trp.

Thus, a codon for the amino acid alanine, a hydrophobic amino acid, may be substituted by a codon encoding another less hydrophobic residue (such as glycine) or a more hydrophobic residue (such as valine, leucine, or isoleucine). Similarly, changes which result in substitution of one negatively charged residue for another (such as aspartic acid for glutamic acid) or one positively charged residue for another (such as lysine for arginine) can also be expected to produce a functionally equivalent product. In many cases, nucleotide changes which result in alteration of the N-terminal and C-terminal portions of the protein molecule would also not be expected to alter the activity of the protein. Each of the proposed modifications is well within the routine skill in the art, as is determination of retention of biological activity of the encoded products.

As used herein, the term "codon optimized", as it refers to genes or coding regions of nucleic acid molecules for transformation of various hosts, refers to the alteration of codons in the gene or coding regions of the nucleic acid molecules to reflect the typical codon usage of the host organism without altering the polypeptide for which the DNA codes.

As used herein, "synthetic genes" can be assembled from oligonucleotide building blocks that are chemically synthesized using procedures known to those skilled in the art. These building blocks are ligated and annealed to form gene segments that are then enzymatically assembled to construct the entire gene. "Chemically synthesized", as pertaining to a DNA sequence, means that the component nucleotides were assembled in vitro. Manual chemical synthesis of DNA may be accomplished using well-established procedures, or automated chemical synthesis can be performed using one of a number of commercially available machines. Accordingly, the genes can be tailored for optimal gene expression based on optimization of nucleotide sequences to reflect the codon bias of the host cell. The skilled artisan appreciates the likelihood of successful gene expression if codon usage is biased towards those codons favored by the host. Determination of preferred codons can be based on a survey of genes derived from the host cell where sequence information is available.

As used herein, "gene" refers to a nucleic acid molecule that expresses a specific protein, including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different from that found in nature. "Endogenous gene" refers to a native gene in its natural location in the genome of an organism. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

As used herein, "coding sequence" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, RNA processing site, effector binding sites, and stem-loop structures.

As used herein, the term "operably linked" refers to the association of nucleic acid sequences on a single nucleic acid molecule so that the function of one is affected by the other. For example, a promoter is operably linked with a coding sequence when it is capable of affecting the expression of that coding sequence, i.e., the coding sequence is under the transcriptional control of the promoter. Coding sequences can be operably linked to regulatory sequences in sense or antisense orientation.

As used herein, the term "expression" refers to the transcription and stable accumulation of sense (mRNA) or antisense RNA derived from the nucleic acid molecule of the disclosure. Expression may also refer to translation of mRNA into a polypeptide.

As used herein, "transformation" refers to the transfer of a nucleic acid molecule into the genome of a host organism, resulting in genetically stable inheritance. In the present disclosure, the host cell's genome includes chromosomal and extrachromosomal (e.g., plasmid) genes. Host organisms containing the transformed nucleic acid molecules are referred to as "transgenic", "recombinant" or "transformed" organisms.

As used herein, the term "sequence analysis software" refers to any computer algorithm or software program that is useful for the analysis of nucleotide or amino acid sequences. "Sequence analysis software" may be commercially available or independently developed. Typical sequence analysis software will include, but is not limited to, the GCG suite of programs (Wisconsin Package Version 9.0, Accelrys Software Corp., San Diego, CA), BLASTP, BLASTN, BLASTX (Altschul et al., *J. Mol. Biol.* 215:403-410 (1990)), and DNASTAR (DNASTAR, Inc. 1228 S. Park St. Madison, WI 53715 USA), CLUSTALW (for example, version 1.83; Thompson et al., *Nucleic Acids Research,* 22(22):4673-4680 (1994)), and the FASTA program incorporating the Smith-Waterman algorithm (W. R. Pearson, *Comput. Methods Genome Res*., [Proc. Int. Symp.] (1994), *Meeting Date* 1992, 111-20. Editor(s): Suhai, Sandor. Publisher: Plenum, New York, NY), Vector NTI (Informax, Bethesda, MD) and Sequencher v. 4.05. Within the context of this application it will be understood that where sequence analysis software is used for analysis, that the results of the analysis will be based on the "default values" of the program referenced, unless otherwise specified. As used herein "default values" will mean any set of values or parameters set by the software manufacturer that originally load with the software when first initialized.

Structural and Functional Properties of the Soluble α-Glucan Oligomer/Polymer Composition The present soluble α-glucan oligomer/polymer composition was prepared from sucrose (e.g., cane sugar) using one or more enzymatic processing aids that have essentially the same amino acid sequences as found in nature (or active truncations thereof) from microorganisms which having a long history of exposure to humans (microorganisms naturally found in the oral cavity or found in foods such a beer, fermented soybeans, etc.). The soluble oligomers/polymers have low viscosity (enabling use in a broad range of applications), The present soluble α-glucan oligomer/polymer composition is characterized by the following combination of parameters:

a. at least 75% α-(1,3) glycosidic linkages;
b. less than 25% α-(1,6) glycosidic linkages;
c. less than 10% α-(1,3,6) glycosidic linkages;
d. a weight average molecular weight ($M_w$) of less than 5000 Daltons;
e. a viscosity of less than 0.25 Pascal second (Pa·s) at 12 wt % in water 20° C.;
f. a solubility of at least 20% (w/w) in pH 7 water at 25° C.; and
g. a polydispersity index (PDI) of less than 5.

In one embodiment, the present soluble α-glucan oligomer/polymer composition comprises at least 75%, preferably at least 80%, more preferably at least 85%, even more preferably at least 90%, and most preferably at least 95% α-(1,3) glycosidic linkages.

In another embodiment, in addition to the α-(1,3) glycosidic linkage embodiments described above, the present soluble α-glucan oligomer/polymer composition further comprises less than 25%, preferably less than 10%, more preferably 5% or less, and even more preferably less than 1% α-(1,6) glycosidic linkages.

In another embodiment, in addition to the α-(1,3) and α-(1,6) glycosidic linkage content embodiments described above, the present soluble α-glucan oligomer/polymer composition further comprises less than 10%, preferably less than 5%, and most preferably less than 2.5% α-(1,3,6) glycosidic linkages.

In a preferred embodiment, the present soluble α-glucan oligomer/polymer composition comprises 93 to 97% α-(1,3) glycosidic linkages and less than 3% α-(1,6) glycosidic linkages and has a weight-average molecular weight corresponding to a DP of 3 to 7 mixture. In a further preferred embodiment, the present soluble α-glucan oligomer/polymer composition comprises about 95% α-(1,3) glycosidic linkages and about 1% α-(1,6) glycosidic linkages and has a weight-average molecular weight corresponding to a DP of 3 to 7 mixture. In a further aspect of the above embodiment, the present soluble α-glucan oligomer/polymer composition further comprises 1 to 3% α-(1,3,6) linkages; preferably about 2% α-(1,3,6) linkages.

In another embodiment, in addition to the above mentioned glycosidic linkage content embodiments, the present soluble α-glucan oligomer/polymer composition further comprises less than 5%, preferably less than 1%, and most preferably less than 0.5% α-(1,4) glycosidic linkages.

In another embodiment, in addition the above mentioned glycosidic linkage content embodiments, the present α-glucan oligomer/polymer composition comprises a weight average molecular weight ($M_w$) of less than 5000 Daltons, preferably less than 2500 Daltons, more preferably between 500 and 2500 Daltons, and most preferably about 500 to about 2000 Daltons.

In another embodiment, in addition to any of the above features, the present α-glucan oligomer/polymer composition comprises a viscosity of less than 250 centipoise (0.25 Pascal second (Pa·s), preferably less than 10 centipoise (cP) (0.01 Pascal second (Pa·s)), preferably less than 7 cP (0.007 Pa·s), more preferably less than 5 cP (0.005 Pa·s), more preferably less than 4 cP (0.004 Pa·s), and most preferably less than 3 cP (0.003 Pa·s) at 12 wt % in water at 20° C.

In addition to any of the above embodiments, the present soluble α-glucan oligomer/polymer composition has a solubility of at least 20% (w/w), preferably at least 30%, 40%, 50%, 60%, or 70% in pH 7 water at 25° C.

Compositions Comprising α-Glucan Oligomer/Polymers and/or α-Glucan Ethers

Depending upon the desired application, the present α-glucan oligomer/polymer composition and/or derivatives thereof (such as the present α-glucan ethers) may be formulated (e.g., blended, mixed, incorporated into, etc.) with one or more other materials and/or active ingredients suitable for use in laundry care, textile/fabric care, and/or personal care products. As such, the present disclosure includes compositions comprising the present glucan oligomer/polymer composition. The term "compositions comprising the present glucan oligomer/polymer composition" in this context may include, for example, aqueous formulations comprising the present glucan oligomer/polymer, rheology modifying compositions, fabric treatment/care compositions, laundry care formulations/compositions, fabric softeners, personal care compositions (hair, skin and oral care), and the like.

The present glucan oligomer/polymer composition may be directed as an ingredient in a desired product or may be blended with one or more additional suitable ingredients (ingredients suitable for fabric care applications, laundry care applications, and/or personal care applications). As such, the present disclosure comprises a fabric care, laundry care, or personal care composition comprising the present soluble α-glucan oligomer/polymer composition, the present α-glucan ethers, or a combination thereof. In one embodiment, the fabric care, laundry care or personal care composition comprises 0.01 to 99 wt % (dry solids basis), preferably 0.1 to 90 wt %, more preferably 1 to 90%, and most preferably 5 to 80 wt % of the glucan oligomer/polymer composition and/or the present α-glucan ether compounds.

In one embodiment, a fabric care composition is provided comprising:

a. an α-glucan oligomer/polymer composition comprising:
   i. at least 75% α-(1,3) glycosidic linkages;
   ii. less than 25% α-(1,6) glycosidic linkages;
   iii. less than 10% α-(1,3,6) glycosidic linkages;
   iv. a weight average molecular weight of less than 5000 Daltons;
   v. a viscosity of less than 0.25 Pascal second (Pa·s) at 12 wt % in water 20° C.;
   vi. a solubility of at least 20% (w/w) in water at 25° C.; and
   vii. a polydispersity index of less than 5; and
b. at least one additional fabric care ingredient.

In another embodiment, a laundry care composition is provided comprising:

a) an α-glucan oligomer/polymer composition comprising:
   i. at least 75% α-(1,3) glycosidic linkages;
   ii. less than 25% α-(1,6) glycosidic linkages;
   iii. less than 10% α-(1,3,6) glycosidic linkages;
   iv. a weight average molecular weight of less than 5000 Daltons;
   v. a viscosity of less than 0.25 Pascal second (Pa·s) at 12 wt % in water 20° C.;
   vi. a solubility of at least 20% (w/w) in water at 25° C.; and vii. a polydispersity index of less than 5; and b) at least one additional laundry care ingredient.

In another embodiment, an α-glucan ether derived from the present α-glucan oligomer/polymer composition is provided comprising:

1) at least 75% α-(1,3) glycosidic linkages;
2) less than 25% α-(1,6) glycosidic linkages;
3) less than 10% α-(1,3,6) glycosidic linkages;
4) a weight average molecular weight of less than 5000 Daltons;
5) a viscosity of less than 0.25 Pascal second (Pa·s) at 12 wt % in water 20° C.;
6) a solubility of at least 20% (w/w) in water at 25° C.; and
7) a polydispersity index of less than 5; wherein the composition has a degree of substitution (DoS) with at least one organic group of about 0.05 to about 3.0.

In a further embodiment to any of the above embodiments, the glucan ether composition has a degree of substitution (DoS) with at least one organic group of about 0.05 to about 3.0.

In a further embodiment to any of the above embodiments, the glucan ether composition comprises at least one organic group wherein the organic group is a carboxy alkyl group, hydroxy alkyl group, or an alkyl group.

In a further embodiment to any of the above embodiments, the at least one organic group is a carboxymethyl, hydroxypropyl, dihydroxypropyl, hydroxyethyl, methyl, or ethyl group.

In a further embodiment to any of the above embodiments, the at least one organic group is a positively charged organic group.

In a further embodiment to any of the above embodiments, the glucan ether is a quaternary ammonium glucan ether.

In a further embodiment to any of the above embodiments, the glucan ether composition is a trimethylammonium hydroxypropyl glucan.

In a further embodiment to any of the above embodiments, an organic group may be an alkyl group such as a methyl, ethyl, propyl, butyl, pentyl, hexyl, heptyl, octyl, nonyl, or decyl group, for example.

In a further embodiment to any of the above embodiments, the organic group may be a substituted alkyl group in which there is a substitution on one or more carbons of the alkyl group. The substitution(s) may be one or more hydroxyl, aldehyde, ketone, and/or carboxyl groups. For example, a substituted alkyl group may be a hydroxy alkyl group, dihydroxy alkyl group, or carboxy alkyl group.

Examples of suitable hydroxy alkyl groups are hydroxymethyl ($-CH_2OH$), hydroxyethyl (e.g., $-CH_2CH_2OH$, $-CH(OH)CH_3$), hydroxypropyl (e.g., $-CH_2CH_2CH_2OH$, $-CH_2CH(OH)CH_3$, $-CH(OH)CH_2CH_3$), hydroxybutyl and hydroxypentyl groups. Other examples include dihydroxy alkyl groups (diols) such as dihydroxymethyl, dihydroxyethyl (e.g., $-CH(OH)CH_2OH$), dihydroxypropyl (e.g., $-CH_2CH(OH)CH_2OH$, $-CH(OH)CH(OH)CH_3$), dihydroxybutyl and dihydroxypentyl groups.

Examples of suitable carboxy alkyl groups are carboxymethyl ($-CH_2COOH$), carboxyethyl (e.g., $-CH_2CH_2COOH$, $-CH(COOH)CH_3$), carboxypropyl (e.g., $-CH_2CH_2CH_2COOH$, $-CH_2CH(COOH)CH_3$, $-CH(COOH)CH_2CH_3$), carboxybutyl and carboxypentyl groups.

Alternatively still, one or more carbons of an alkyl group can have a substitution(s) with another alkyl group. Examples of such substituent alkyl groups are methyl, ethyl and propyl groups. To illustrate, an organic group can be $-CH(CH_3)CH_2CH_3$ or $-CH_2CH(CH_3)CH_3$, for example, which are both propyl groups having a methyl substitution.

As should be clear from the above examples of various substituted alkyl groups, a substitution (e.g., hydroxy or carboxy group) on an alkyl group in certain embodiments may be bonded to the terminal carbon atom of the alkyl group, where the terminal carbon group is opposite the terminus that is in ether linkage to a glucose monomeric unit in an α-glucan ether compound. An example of this terminal substitution is the hydroxypropyl group $-CH_2CH_2CH_2OH$. Alternatively, a substitution may be on an internal carbon atom of an alkyl group. An example on an internal substitution is the hydroxypropyl group $-CH_2CH(OH)CH_3$. An alkyl group can have one or more substitutions, which may be the same (e.g., two hydroxyl groups [dihydroxy]) or different (e.g., a hydroxyl group and a carboxyl group).

In a further embodiment to any of the above embodiments, the α-glucan ether compounds disclosed herein may contain one type of organic group. Examples of such compounds contain a carboxy alkyl group as the organic group (carboxyalkyl α-glucan, generically speaking). A specific non-limiting example of such a compound is carboxymethyl α-glucan.

In a further embodiment to any of the above embodiments, α-glucan ether compounds disclosed herein can contain two or more different types of organic groups. Examples of such compounds contain (i) two different alkyl groups as organic groups, (ii) an alkyl group and a hydroxy alkyl group as organic groups (alkyl hydroxyalkyl α-glucan, generically speaking), (iii) an alkyl group and a carboxy alkyl group as organic groups (alkyl carboxyalkyl α-glucan, generically speaking), (iv) a hydroxy alkyl group and a carboxy alkyl group as organic groups (hydroxyalkyl carboxyalkyl α-glucan, generically speaking), (v) two different hydroxy alkyl groups as organic groups, or (vi) two different carboxy alkyl groups as organic groups. Specific non-limiting examples of such compounds include ethyl hydroxyethyl α-glucan, hydroxyalkyl methyl α-glucan, carboxymethyl hydroxyethyl α-glucan, and carboxymethyl hydroxypropyl α-glucan.

In a further embodiment to any of the above embodiments, the organic group herein can alternatively be a positively charged organic group. As defined above, a positively charged organic group comprises a chain of one or more carbons having one or more hydrogens substituted with another atom or functional group, where one or more of the substitutions is with a positively charged group.

A positively charged group may be a substituted ammonium group, for example. Examples of substituted ammonium groups are primary, secondary, tertiary and quaternary ammonium groups. Structure I depicts a primary, secondary, tertiary or quaternary ammonium group, depending on the composition of $R_2$, $R_3$ and $R_4$ in structure I. Each of $R_2$, $R_3$ and $R_4$ in structure I independently represent a hydrogen atom or an alkyl, aryl, cycloalkyl, aralkyl, or alkaryl group. Alternatively, each of $R_2$, $R_3$ and $R_4$ in can independently represent a hydrogen atom or an alkyl group. An alkyl group can be a methyl, ethyl, propyl, butyl, pentyl, hexyl, heptyl, octyl, nonyl, or decyl group, for example. Where two or three of $R_2$, $R_3$ and $R_4$ are an alkyl group, they can be the same or different alkyl groups.

A "primary ammonium α-glucan ether compound" herein can comprise a positively charged organic group having an ammonium group. In this example, the positively charged organic group comprises structure I in which each of $R_2$, $R_3$ and $R_4$ is a hydrogen atom. A non-limiting example of such a positively charged organic group is represented by structure II when each of $R_2$, $R_3$ and $R_4$ is a hydrogen atom. An example of a primary ammonium α-glucan ether compound can be represented in shorthand as ammonium α-glucan ether. It would be understood that a first member (i.e., $R_1$) implied by "primary" in the above nomenclature is the chain of one or more carbons of the positively charged organic group that is ether-linked to a glucose monomer of α-glucan.

A "secondary ammonium α-glucan ether compound" herein can comprise a positively charged organic group having a monoalkylammonium group, for example. In this example, the positively charged organic group comprises structure I in which each of $R_2$ and $R_3$ is a hydrogen atom and $R_4$ is an alkyl group. A non-limiting example of such a positively charged organic group is represented by structure II when each of $R_2$ and $R_3$ is a hydrogen atom and $R_4$ is an alkyl group. An example of a secondary ammonium α-glucan ether compound can be represented in shorthand herein as monoalkylammonium α-glucan ether (e.g., monomethyl-, monoethyl-, monopropyl-, monobutyl-, monopentyl-, monohexyl-, monoheptyl-, monooctyl-, monononyl- or monodecyl-ammonium α-glucan ether). It would be understood that a second member (i.e., $R_1$) implied by "secondary" in the above nomenclature is the chain of one or more carbons of the positively charged organic group that is ether-linked to a glucose monomer of α-glucan.

A "tertiary ammonium α-glucan ether compound" herein can comprise a positively charged organic group having a dialkylammonium group, for example. In this example, the positively charged organic group comprises structure I in which $R_2$ is a hydrogen atom and each of $R_3$ and $R_4$ is an alkyl group. A non-limiting example of such a positively charged organic group is represented by structure II when $R_2$ is a hydrogen atom and each of $R_3$ and $R_4$ is an alkyl group. An example of a tertiary ammonium α-glucan ether compound can be represented in shorthand as dialkylammonium α-glucan ether (e.g., dimethyl-, diethyl-, dipropyl-, dibutyl-, dipentyl-, dihexyl-, diheptyl-, dioctyl-, dinonyl- or didecyl-ammonium α-glucan ether). It would be understood that a third member (i.e., $R_1$) implied by "tertiary" in the above nomenclature is the chain of one or more carbons of the positively charged organic group that is ether-linked to a glucose monomer of α-glucan.

A "quaternary ammonium α-glucan ether compound" herein can comprise a positively charged organic group having a trialkylammonium group, for example. In this example, the positively charged organic group comprises structure I in which each of $R_2$, $R_3$ and $R_4$ is an alkyl group. A non-limiting example of such a positively charged organic group is represented by structure II when each of $R_2$, $R_3$ and $R_4$ is an alkyl group. An example of a quaternary ammonium α-glucan ether compound can be represented in shorthand as trialkylammonium α-glucan ether (e.g., trimethyl-, triethyl-, tripropyl-, tributyl-, tripentyl-, trihexyl-, triheptyl-, trioctyl-, trinonyl- or tridecyl-ammonium α-glucan ether). It would be understood that a fourth member (i.e., $R_1$) implied by "quaternary" in the above nomenclature is the chain of one or more carbons of the positively charged organic group that is ether-linked to a glucose monomer of α-glucan.

Additional non-limiting examples of substituted ammonium groups that can serve as a positively charged group herein are represented in structure I when each of $R_2$, $R_3$ and $R_4$ independently represent a hydrogen atom; an alkyl group such as a methyl, ethyl, or propyl group; an aryl group such as a phenyl or naphthyl group; an aralkyl group such as a benzyl group; an alkaryl group; or a cycloalkyl group. Each of $R_2$, $R_3$ and $R_4$ may further comprise an amino group or a hydroxyl group, for example.

The nitrogen atom in a substituted ammonium group represented by structure I is bonded to a chain of one or more carbons as comprised in a positively charged organic group. This chain of one or more carbons ("carbon chain") is ether-linked to a glucose monomer of α-glucan, and may have one or more substitutions in addition to the substitution with the nitrogen atom of the substituted ammonium group. There can be 1, 2, 3, 4, 5, 6, 7, 8, 9 or 10 carbons, for example, in a carbon chain. To illustrate, the carbon chain of structure II is 3 carbon atoms in length.

Examples of a carbon chain of a positively charged organic group that do not have a substitution in addition to the substitution with a positively charged group include $—CH_2—$, $—CH_2CH_2—$, $—CH_2CH_2CH_2—$, $—CH_2CH_2CH_2CH_2—$ and $—CH_2CH_2CH_2CH_2CH_2—$. In each of these examples, the first carbon atom of the chain is ether-linked to a glucose monomer of α-glucan, and the last carbon atom of the chain is linked to a positively charged group. Where the positively charged group is a substituted ammonium group, the last carbon atom of the chain in each of these examples is represented by the C in structure I.

Where a carbon chain of a positively charged organic group has a substitution in addition to a substitution with a positively charged group, such additional substitution may be with one or more hydroxyl groups, oxygen atoms (thereby forming an aldehyde or ketone group), alkyl groups (e.g., methyl, ethyl, propyl, butyl), and/or additional positively charged groups. A positively charged group is typically bonded to the terminal carbon atom of the carbon chain.

Examples of a carbon chain of a positively charged organic group having one or more substitutions with a hydroxyl group include hydroxyalkyl (e.g., hydroxyethyl, hydroxypropyl, hydroxybutyl, hydroxypentyl) groups and dihydroxyalkyl (e.g., dihydroxyethyl, dihydroxypropyl, dihydroxybutyl, dihydroxypentyl) groups. Examples of hydroxyalkyl and dihydroxyalkyl (diol) carbon chains include $—CH(OH)—$, $—CH(OH)CH_2—$, $—C(OH)_2CH_2—$, $—CH_2CH(OH)CH_2—$, $—CH(OH)CH_2CH_2—$, $—CH(OH)CH(OH)CH_2—$, $—CH_2CH_2CH(OH)CH_2—$, $—CH_2CH(OH)CH_2CH_2—$, $—CH(OH)CH_2CH_2CH_2—$, $—CH_2CH(OH)CH(OH)CH_2—$, $—CH(OH)CH(OH)CH_2CH_2—$ and $—CH(OH)CH_2CH(OH)CH_2—$. In each of these examples, the first carbon atom of the chain is ether-linked to a glucose monomer of the present α-glucan, and the last carbon atom of the chain is linked to a positively charged group. Where the positively charged group is a substituted ammonium group, the last carbon atom of the chain in each of these examples is represented by the C in structure I.

Examples of a carbon chain of a positively charged organic group having one or more substitutions with an alkyl group include chains with one or more substituent methyl, ethyl and/or propyl groups. Examples of methylalkyl groups include $—CH(CH_3)CH_2CH_2—$ and $—CH_2CH(CH_3)CH_2—$, which are both propyl groups having a methyl substitution. In each of these examples, the first carbon atom of the chain is ether-linked to a glucose monomer of the present α-glucan, and the last carbon atom of the chain is linked to a positively charged group. Where the positively charged group is a substituted ammonium group, the last carbon atom of the chain in each of these examples is represented by the C in structure I.

In a further embodiment to any of the above embodiments, the α-glucan ether compounds herein may contain one type of positively charged organic group. For example, one or more positively charged organic groups ether-linked to the glucose monomer of α-glucan may be trimethylammonium hydroxypropyl groups (structure II). Alternatively, α-glucan ether compounds disclosed herein can contain two or more different types of positively charged organic groups.

In a further embodiment to any of the above embodiments, α-glucan ether compounds herein can comprise at least one nonionic organic group and at least one anionic group, for example. As another example, α-glucan ether compounds herein can comprise at least one nonionic organic group and at least one positively charged organic group.

In a further embodiment to any of the above embodiments, α-glucan ether compounds may be derived from any of the present α-glucan oligomers/polymers disclosed herein. For example, the α-glucan ether compound can be produced by ether-derivatizing the present α-glucan oligomers/polymers using an etherification reaction as disclosed herein.

In certain embodiments of the disclosed disclosure, a composition comprising an α-glucan ether compound can be a hydrocolloid or aqueous solution having a viscosity of at least about 10 cPs. Alternatively, such a hydrocolloid or aqueous solution has a viscosity of at least about 100, 250, 500, 750, 1000, 1250, 1500, 1750, 2000, 2250, 2500, 3000, 3500, or 4000 cPs (or any value between 100 and 4000 cPs), for example.

Viscosity can be measured with the hydrocolloid or aqueous solution at any temperature between about 3° C. to about 110° C. (or any integer between 3 and 110° C.). Alternatively, viscosity can be measured at a temperature between about 4° C. to 30° C., or about 20° C. to 25° C. Viscosity can be measured at atmospheric pressure (about 760 torr) or any other higher or lower pressure.

The viscosity of a hydrocolloid or aqueous solution disclosed herein can be measured using a viscometer or rheometer, or using any other means known in the art. It would be understood by those skilled in the art that a viscometer or rheometer can be used to measure the viscosity of those hydrocolloids and aqueous solutions of the disclosure that exhibit shear thinning behavior or shear thickening behavior (i.e., liquids with viscosities that vary with flow conditions). The viscosity of such embodiments can be measured at a rotational shear rate of about 10 to 1000 rpm (revolutions per minute) (or any integer between 10 and 1000 rpm), for example. Alternatively, viscosity can be measured at a rotational shear rate of about 10, 60, 150, 250, or 600 rpm.

The pH of a hydrocolloid or aqueous solution disclosed herein can be between about 2.0 to about 12.0. Alternatively, pH can be about 2.0, 3.0, 4.0, 5.0, 6.0, 7.0, 8.0, 9.0, 10.0, 11.0, 12.0; or between 5.0 to about 12.0; or between about 4.0 and 8.0; or between about 5.0 and 8.0.

An aqueous composition herein such as a hydrocolloid or aqueous solution can comprise a solvent having at least about 20 wt % water. In other embodiments, a solvent is at least about 30, 40, 50, 60, 70, 80, 90, or 100 wt % water (or any integer value between 20 and 100 wt %), for example.

In a further embodiment to any of the above embodiments, the α-glucan ether compound disclosed herein can be present in a hydrocolloid or aqueous solution at a weight percentage (wt %) of at least about 0.01%, 0.05%, 0.1%, 0.2%, 0.3%, 0.4%, 0.5%, 0.6%, 0.7%, 0.8%, 0.9%, 1.0%, 1.2%, 1.4%, 1.6%, 1.8%, 2.0%, 2.5%, 3.0%, 3.5%, 4.0%, 4.5%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, or 30%, for example.

In a further embodiment to any of the above embodiments, the hydrocolloid or aqueous solution herein can comprise other components in addition to one or more α-glucan ether compounds. For example, the hydrocolloid or aqueous solution can comprise one or more salts such as a sodium salt (e.g., NaCl, $Na_2SO_4$). Other non-limiting examples of salts include those having (i) an aluminum, ammonium, barium, calcium, chromium (II or III), copper (I or II), iron (II or III), hydrogen, lead (II), lithium, magnesium, manganese (II or III), mercury (I or II), potassium, silver, sodium strontium, tin (II or IV), or zinc cation, and (ii) an acetate, borate, bromate, bromide, carbonate, chlorate, chloride, chlorite, chromate, cyanamide, cyanide, dichromate, dihydrogen phosphate, ferricyanide, ferrocyanide, fluoride, hydrogen carbonate, hydrogen phosphate, hydrogen sulfate, hydrogen sulfide, hydrogen sulfite, hydride, hydroxide, hypochlorite, iodate, iodide, nitrate, nitride, nitrite, oxalate, oxide, perchlorate, permanganate, peroxide, phosphate, phosphide, phosphite, silicate, stannate, stannite, sulfate, sulfide, sulfite, tartrate, or thiocyanate anion. Thus, any salt having a cation from (i) above and an anion from (ii) above can be in a hydrocolloid or aqueous solution, for example. A salt can be present in a hydrocolloid or aqueous solution at a wt % of about 0.01% to about 10.00% (or any hundredth increment between 0.01% and 10.00%), for example.

In a further embodiment to any of the above embodiments, those skilled in the art would understand that in certain embodiments, the α-glucan ether compound can be in an anionic form in a hydrocolloid or aqueous solution. Examples may include those α-glucan ether compounds having an organic group comprising an alkyl group substituted with a carboxyl group. Carboxyl (COOH) groups in a carboxyalkyl α-glucan ether compound can convert to carboxylate ($COO^-$) groups in aqueous conditions. Such anionic groups can interact with salt cations such as any of those listed above in (i) (e.g., potassium, sodium, or lithium cation). Thus, an α-glucan ether compound can be a sodium carboxyalkyl α-glucan ether (e.g., sodium carboxymethyl α-glucan), potassium carboxyalkyl α-glucan ether (e.g., potassium carboxymethyl α-glucan), or lithium carboxyalkyl α-glucan ether (e.g., lithium carboxymethyl α-glucan), for example.

In alternative embodiments to any of the above embodiments, a composition comprising the α-glucan ether compound herein can be non-aqueous (e.g., a dry composition). Examples of such embodiments include powders, granules, microcapsules, flakes, or any other form of particulate matter. Other examples include larger compositions such as pellets, bars, kernels, beads, tablets, sticks, or other agglomerates. A non-aqueous or dry composition herein typically has less than 3, 2, 1, 0.5, or 0.1 wt % water comprised therein.

In certain embodiments the α-glucan ether compound may be crosslinked using any means known in the art. Such crosslinks may be borate crosslinks, where the borate is from any boron-containing compound (e.g., boric acid, diborates, tetraborates, pentaborates, polymeric compounds such as POLYBOR®, polymeric compounds of boric acid, alkali borates), for example. Alternatively, crosslinks can be provided with polyvalent metals such as titanium or zirconium. Titanium crosslinks may be provided, for example, using titanium IV-containing compounds such as titanium ammonium lactate, titanium triethanolamine, titanium acetylacetonate, and polyhydroxy complexes of titanium. Zirconium crosslinks can be provided using zirconium IV-containing compounds such as zirconium lactate, zirconium carbonate, zirconium acetylacetonate, zirconium triethanolamine, zirconium diisopropylamine lactate and polyhydroxy complexes of zirconium, for example. Alternatively still, crosslinks can be provided with any crosslinking agent described in U.S. Pat. Nos. 4,462,917, 4,464,270, 4,477,360 and 4,799,550, which are all incorporated herein by reference. A crosslinking agent (e.g., borate) may be present in an aqueous composition herein at a concentration of about 0.2% to 20 wt %, or about 0.1, 0.2, 0.3, 0.4, 0.5, 1, 2, 3, 4, 5, 6, 7, 8, 9, 10, 15, or 20 wt %, for example.

It is believed that an α-glucan ether compound disclosed herein that is crosslinked typically has a higher viscosity in an aqueous solution compared to its non-crosslinked counterpart. In addition, it is believed that a crosslinked α-glucan ether compound can have increased shear thickening behavior compared to its non-crosslinked counterpart.

In a further embodiment to any of the above embodiments, a composition herein (fabric care, laundry care, personal care, etc.) may optionally contain one or more active enzymes. Non-limiting examples of suitable enzymes include proteases, cellulases, hemicellulases, peroxidases, lipolytic enzymes (e.g., metallolipolytic enzymes), xylanases, lipases, phospholipases, esterases (e.g., arylesterase, polyesterase), perhydrolases, cutinases, pectinases, pectate lyases, mannanases, keratinases, reductases, oxidases (e.g., choline oxidase), phenoloxidases, lipoxygenases, ligninases, pullulanases, tannases, pentosanases, malanases, beta-glucanases, arabinosidases, hyaluronidases, chondroitinases, laccases, metalloproteinases, amadoriases, glucoamylases, arabinofuranosidases, phytases, isomerases, transferases and amylases. If an enzyme(s) is included, it may be comprised in a composition herein at about 0.0001-0.1 wt % (e.g., 0.01-0.03 wt %) active enzyme (e.g., calculated as pure enzyme protein), for example.

A cellulase herein can have endocellulase activity (EC 3.2.1.4), exocellulase activity (EC 3.2.1.91), or cellobiase activity (EC 3.2.1.21). A cellulase herein is an "active cellulase" having activity under suitable conditions for maintaining cellulase activity; it is within the skill of the art to determine such suitable conditions. Besides being able to degrade cellulose, a cellulase in certain embodiments can also degrade cellulose ether derivatives such as carboxymethyl cellulose. Examples of cellulose ether derivatives which are expected to not be stable to cellulase are disclosed in U.S. Pat. Nos. 7,012,053, 7,056,880, 6,579,840, 7,534,759 and 7,576,048.

A cellulase herein may be derived from any microbial source, such as a bacteria or fungus. Chemically-modified cellulases or protein-engineered mutant cellulases are included. Suitable cellulases include, but are not limited to, cellulases from the genera *Bacillus, Pseudomonas, Streptomyces, Trichoderma, Humicola, Fusarium, Thielavia* and *Acremonium*. As other examples, a cellulase may be derived from *Humicola insolens, Myceliophthora thermophila* or *Fusarium oxysporum*; these and other cellulases are disclosed in U.S. Pat. Nos. 4,435,307, 5,648,263, 5,691,178, 5,776,757 and 7,604,974, which are all incorporated herein by reference. Exemplary *Trichoderma reesei* cellulases are disclosed in U.S. Pat. Nos. 4,689,297, 5,814,501, 5,324,649, and International Patent Appl. Publ. Nos. WO92/06221 and WO92/06165, all of which are incorporated herein by reference. Exemplary *Bacillus* cellulases are disclosed in U.S. Pat. No. 6,562,612, which is incorporated herein by reference. A cellulase, such as any of the foregoing, preferably is in a mature form lacking an N-terminal signal peptide. Commercially available cellulases useful herein include CELLUZYME® and CAREZYME® (Novozymes A/S); CLAZINASE® and PURADAX® HA (DuPont Industrial Biosciences), and KAC-500(B)® (Kao Corporation).

Alternatively, a cellulase herein may be produced by any means known in the art, such as described in U.S. Pat. Nos. 4,435,307, 5,776,757 and 7,604,974, which are incorporated herein by reference. For example, a cellulase may be produced recombinantly in a heterologous expression system, such as a microbial or fungal heterologous expression system. Examples of heterologous expression systems include bacterial (e.g., *E. coli, Bacillus* sp.) and eukaryotic systems. Eukaryotic systems can employ yeast (e.g., *Pichia* sp., *Saccharomyces* sp.) or fungal (e.g., *Trichoderma* sp. such as *T. reesei, Aspergillus* species such as *A. niger*) expression systems, for example.

One or more cellulases can be directly added as an ingredient when preparing a composition disclosed herein. Alternatively, one or more cellulases can be indirectly (inadvertently) provided in the disclosed composition. For example, cellulase can be provided in a composition herein by virtue of being present in a non-cellulase enzyme preparation used for preparing a composition. Cellulase in compositions in which cellulase is indirectly provided thereto can be present at about 0.1-10 ppb (e.g., less than 1 ppm), for example. A contemplated benefit of a composition herein, by virtue of employing a poly alpha-1,3-1,6-glucan ether compound instead of a cellulose ether compound, is that non-cellulase enzyme preparations that might have background cellulase activity can be used without concern that the desired effects of the glucan ether will be negated by the background cellulase activity.

A cellulase in certain embodiments can be thermostable. Cellulase thermostability refers to the ability of the enzyme to retain activity after exposure to an elevated temperature (e.g. about 60-70° C.) for a period of time (e.g., about 30-60 minutes). The thermostability of a cellulase can be measured by its half-life (t½) given in minutes, hours, or days, during which time period half the cellulase activity is lost under defined conditions.

A cellulase in certain embodiments can be stable to a wide range of pH values (e.g. neutral or alkaline pH such as pH of ~7.0 to ~11.0). Such enzymes can remain stable for a predetermined period of time (e.g., at least about 15 min., 30 min., or 1 hour) under such pH conditions.

At least one, two, or more cellulases may be included in the composition. The total amount of cellulase in a composition herein typically is an amount that is suitable for the purpose of using cellulase in the composition (an "effective amount"). For example, an effective amount of cellulase in a composition intended for improving the feel and/or appearance of a cellulose-containing fabric is an amount that produces measurable improvements in the feel of the fabric (e.g., improving fabric smoothness and/or appearance, removing pills and fibrils which tend to reduce fabric appearance sharpness). As another example, an effective amount of cellulase in a fabric stonewashing composition herein is that amount which will provide the desired effect (e.g., to produce a worn and faded look in seams and on fabric panels). The amount of cellulase in a composition herein can also depend on the process parameters in which the composition is employed (e.g., equipment, temperature, time, and the like) and cellulase activity, for example. The effective concentration of cellulase in an aqueous composition in which a fabric is treated can be readily determined by a skilled artisan. In fabric care processes, cellulase can be present in an aqueous composition (e.g., wash liquor) in which a fabric is treated in a concentration that is minimally about 0.01-0.1 ppm total cellulase protein, or about 0.1-10 ppb total cellulase protein (e.g., less than 1 ppm), to maximally about 100, 200, 500, 1000, 2000, 3000, 4000, or 5000 ppm total cellulase protein, for example.

In a further embodiment to any of the above embodiments, the α-glucan oligomer/polymers and/or the present α-glucan ethers (derived from the present α-glucan oligomer/polymers) are mostly or completely stable (resistant) to being degraded by cellulase. For example, the percent degradation of the present α-glucan oligomers/polymers and/or α-glucan ether compounds by one or more cellulases is less than 10%, 9%, 8%, 7%, 6%, 5%, 4%, 3%, 2%, or 1%, or is 0%. Such percent degradation can be determined, for example, by comparing the molecular weight of polymer before and after treatment with a cellulase for a period of time (e.g., ~24 hours).

In a further embodiment to any of the above embodiments, hydrocolloids and aqueous solutions in certain embodiments of the disclosure are believed to have either shear thinning behavior or shear thickening behavior. Shear thinning behavior is observed as a decrease in viscosity of the hydrocolloid or aqueous solution as shear rate increases, whereas shear thickening behavior is observed as an increase in viscosity of the hydrocolloid or aqueous solution as shear rate increases. Modification of the shear thinning behavior or shear thickening behavior of an aqueous solution herein is due to the admixture of the α-glucan ether to the aqueous composition. Thus, one or more α-glucan ether compounds can be added to an aqueous composition to modify its rheological profile (i.e., the flow properties of the aqueous liquid, solution, or mixture are modified). Also, one or more α-glucan ether compounds can be added to an aqueous composition to modify its viscosity.

The rheological properties of hydrocolloids and aqueous solutions can be observed by measuring viscosity over an increasing rotational shear rate (e.g., from about 10 rpm to about 250 rpm). For example, shear thinning behavior of a hydrocolloid or aqueous solution disclosed herein can be observed as a decrease in viscosity (cPs) by at least about 5%, 10%, 15%, 20%, 25%, 30%, 35%, 40%, 45%, 50%, 55%, 60%, 65%, 70%, 75%, 80%, 85%, 90%, or 95% (or any integer between 5% and 95%) as the rotational shear rate increases from about 10 rpm to 60 rpm, 10 rpm to 150 rpm, 10 rpm to 250 rpm, 60 rpm to 150 rpm, 60 rpm to 250 rpm, or 150 rpm to 250 rpm. As another example, shear thickening behavior of a hydrocolloid or aqueous solution disclosed herein can be observed as an increase in viscosity (cPs) by at least about 5%, 10%, 15%, 20%, 25%, 30%, 35%, 40%, 45%, 50%, 55%, 60%, 65%, 70%, 75%, 80%, 85%, 90%, 95%, 100%, 125%, 150%, 175%, or 200% (or any integer between 5% and 200%) as the rotational shear rate increases from about 10 rpm to 60 rpm, 10 rpm to 150 rpm, 10 rpm to 250 rpm, 60 rpm to 150 rpm, 60 rpm to 250 rpm, or 150 rpm to 250 rpm.

A hydrocolloid or aqueous solution disclosed herein can be in the form of, and/or comprised in, a textile care product, a laundry care product, a personal care product, a pharmaceutical product, or industrial product. The present α-glucan oligomers/polymers and/or the present α-glucan ether compounds can be used as thickening agents and/or dispersion agents in each of these products. Such a thickening agent may be used in conjunction with one or more other types of thickening agents if desired, such as those disclosed in U.S. Pat. No. 8,541,041, the disclosure of which is incorporated herein by reference in its entirety.

A household and/or industrial product herein can be in the form of drywall tape-joint compounds; mortars; grouts; cement plasters; spray plasters; cement stucco; adhesives; pastes; wall/ceiling texturizers; binders and processing aids for tape casting, extrusion forming, injection molding and ceramics; spray adherents and suspending/dispersing aids for pesticides, herbicides, and fertilizers; fabric care products such as fabric softeners and laundry detergents; hard surface cleaners; air fresheners; polymer emulsions; gels such as water-based gels; surfactant solutions; paints such as water-based paints; protective coatings; adhesives; sealants and caulks; inks such as water-based ink; metal-working fluids; emulsion-based metal cleaning fluids used in electroplating, phosphatizing, galvanizing and/or general metal cleaning operations; hydraulic fluids (e.g., those used for fracking in downhole operations); and aqueous mineral slurries, for example.

In a further embodiment to any of the above embodiments, compositions disclosed herein can be in the form of a fabric care composition. A fabric care composition herein can be used for hand wash, machine wash and/or other purposes such as soaking and/or pretreatment of fabrics, for example. A fabric care composition may take the form of, for example, a laundry detergent; fabric conditioner; any wash-, rinse-, or dryer-added product; unit dose or spray. Fabric care compositions in a liquid form may be in the form of an aqueous composition as disclosed herein. In other aspects, a fabric care composition can be in a dry form such as a granular detergent or dryer-added fabric softener sheet. Other non-limiting examples of fabric care compositions herein include: granular or powder-form all-purpose or heavy-duty washing agents; liquid, gel or paste-form all-purpose or heavy-duty washing agents; liquid or dry fine-fabric (e.g. delicates) detergents; cleaning auxiliaries such as bleach additives, "stain-stick", or pre-treatments; substrate-laden products such as dry and wetted wipes, pads, or sponges; sprays and mists.

A detergent composition herein may be in any useful form, e.g., as powders, granules, pastes, bars, unit dose, or liquid. A liquid detergent may be aqueous, typically containing up to about 70 wt % of water and 0 wt % to about 30 wt % of organic solvent. It may also be in the form of a compact gel type containing only about 30 wt % water.

A detergent composition herein typically comprises one or more surfactants, wherein the surfactant is selected from nonionic surfactants, anionic surfactants, cationic surfactants, ampholytic surfactants, zwitterionic surfactants, semi-polar nonionic surfactants and mixtures thereof. In some embodiments, the surfactant is present at a level of from about 0.1% to about 60%, while in alternative embodiments the level is from about 1% to about 50%, while in still further embodiments the level is from about 5% to about 40%, by weight of the cleaning composition. A detergent will usually contain 0 wt % to about 50 wt % of an anionic surfactant such as linear alkylbenzenesulfonate (LAS), alpha-olefinsulfonate (AOS), alkyl sulfate (fatty alcohol sulfate) (AS), alcohol ethoxysulfate (AEOS or AES), secondary alkanesulfonates (SAS), alpha-sulfo fatty acid methyl esters, alkyl- or alkenylsuccinic acid, or soap. In addition, a detergent composition may optionally contain 0 wt % to about 40 wt % of a nonionic surfactant such as alcohol ethoxylate (AEO or AE), carboxylated alcohol ethoxylates, nonylphenol ethoxylate, alkylpolyglycoside, alkyldimethylamineoxide, ethoxylated fatty acid monoethanolamide, fatty acid monoethanolamide, or polyhydroxy alkyl fatty acid amide (as described for example in WO92/06154, which is incorporated herein by reference).

A detergent composition herein typically comprise one or more detergent builders or builder systems. In some embodiments incorporating at least one builder, the cleaning compositions comprise at least about 1%, from about 3% to about 60% or even from about 5% to about 40% builder by weight of the cleaning composition. Builders include, but are not limited to, the alkali metal, ammonium and alkanolammonium salts of polyphosphates, alkali metal silicates, alkaline earth and alkali metal carbonates, aluminosilicates, polycarboxylate compounds, ether hydroxypolycarboxylates, copolymers of maleic anhydride with ethylene or vinyl methyl ether, 1, 3, 5-trihydroxy benzene-2, 4, 6-trisulphonic acid, and carboxymethyloxysuccinic acid, the various alkali metal, ammonium and substituted ammonium salts of polyacetic acids such as ethylenediamine tetraacetic acid and nitrilotriacetic acid, as well as polycarboxylates such as mellitic acid, succinic acid, citric acid, oxydisuccinic acid, polymaleic acid, benzene 1,3,5-tricarboxylic acid, carboxymethyloxysuccinic acid, and soluble salts thereof. Indeed, it is contemplated that any suitable builder will find use in various embodiments of the present disclosure. Examples of a detergent builder or complexing agent include zeolite, diphosphate, triphosphate, phosphonate, citrate, nitrilotriacetic acid (NTA), ethylenediaminetetraacetic acid (EDTA), diethylenetriaminepentaacetic acid (DTMPA), alkyl- or alkenylsuccinic acid, soluble silicates or layered silicates (e.g., SKS-6 from Hoechst). A detergent may also be unbuilt, i.e., essentially free of detergent builder.

In some embodiments, the builders form water-soluble hardness ion complexes (e.g., sequestering builders), such as citrates and polyphosphates (e.g., sodium tripolyphosphate and sodium tripolyphosphate hexahydrate, potassium tripolyphosphate, and mixed sodium and potassium tripolyphosphate, etc.). It is contemplated that any suitable builder will find use in the present disclosure, including those known in the art (See e.g., EP 2 100 949).

In some embodiments, builders for use herein include phosphate builders and non-phosphate builders. In some embodiments, the builder is a phosphate builder. In some embodiments, the builder is a non-phosphate builder. If present, builders are used in a level of from 0.1% to 80%, or from 5 to 60%, or from 10 to 50% by weight of the composition. In some embodiments the product comprises a mixture of phosphate and non-phosphate builders. Suitable phosphate builders include mono-phosphates, di-phosphates, tri-polyphosphates or oligomeric-polyphosphates, including the alkali metal salts of these compounds, including the sodium salts. In some embodiments, a builder can be sodium tripolyphosphate (STPP). Additionally, the composition can comprise carbonate and/or citrate, preferably citrate that helps to achieve a neutral pH composition of the disclosure. Other suitable non-phosphate builders include homopolymers and copolymers of polycarboxylic acids and their partially or completely neutralized salts, monomeric polycarboxylic acids and hydroxycarboxylic acids and their salts. In some embodiments, salts of the above mentioned compounds include the ammonium and/or alkali metal salts, i.e. the lithium, sodium, and potassium salts, including sodium salts. Suitable polycarboxylic acids include acyclic, alicyclic, hetero-cyclic and aromatic carboxylic acids, wherein in some embodiments, they can contain at least two carboxyl groups which are in each case separated from one another by, in some instances, no more than two carbon atoms.

A detergent composition herein can comprise at least one chelating agent. Suitable chelating agents include, but are not limited to copper, iron and/or manganese chelating agents and mixtures thereof. In embodiments in which at least one chelating agent is used, the cleaning compositions of the present disclosure comprise from about 0.1% to about 15% or even from about 3.0% to about 10% chelating agent by weight of the subject cleaning composition.

A detergent composition herein can comprise at least one deposition aid. Suitable deposition aids include, but are not limited to, polyethylene glycol, polypropylene glycol, polycarboxylate, soil release polymers such as polytelephthalic acid, clays such as kaolinite, montmorillonite, atapulgite, illite, bentonite, halloysite, and mixtures thereof.

A detergent composition herein can comprise one or more dye transfer inhibiting agents. Suitable polymeric dye transfer inhibiting agents include, but are not limited to, polyvinylpyrrolidone polymers, polyamine N-oxide polymers, copolymers of N-vinylpyrrolidone and N-vinylimidazole, polyvinyloxazolidones and polyvinylimidazoles or mixtures thereof. Additional dye transfer inhibiting agents include manganese phthalocyanine, peroxidases, polyvinylpyrrolidone polymers, polyamine N-oxide polymers, copolymers of N-vinylpyrrolidone and N-vinylimidazole, polyvinyloxazolidones and polyvinylimidazoles and/or mixtures thereof; chelating agents examples of which include ethylene-diamine-tetraacetic acid (EDTA); diethylene triamine penta methylene phosphonic acid (DTPMP); hydroxy-ethane diphosphonic acid (HEDP); ethylenediamine N,N'-disuccinic acid (EDDS); methyl glycine diacetic acid (MGDA); diethylene triamine penta acetic acid (DTPA); propylene diamine tetracetic acid (PDT A); 2-hydroxypyridine-N-oxide (HPNO); or methyl glycine diacetic acid (MGDA); glutamic acid N,N-diacetic acid (N,N-dicarboxymethyl glutamic acid tetrasodium salt (GLDA); nitrilotriacetic acid (NTA); 4,5-dihydroxy-m-benzenedisulfonic acid; citric acid and any salts thereof; N-hydroxyethylethylenediaminetriacetic acid (HEDTA), triethylenetetraaminehexaacetic acid (TTNA), N-hydroxyethyliminodiacetic acid (HEIDA), dihydroxyethylglycine (DHEG), ethylenediaminetetrapropionic acid (EDTP) and derivatives thereof, which can be used alone or in combination with any of the above. In embodiments in which at least one dye transfer inhibiting agent is used, the cleaning compositions of the present disclosure comprise from about 0.0001% to about 10%, from about 0.01% to about 5%, or even from about 0.1% to about 3% by weight of the cleaning composition.

A detergent composition herein can comprise silicates. In some such embodiments, sodium silicates (e.g., sodium disilicate, sodium metasilicate, and crystalline phyllosilicates) find use. In some embodiments, silicates are present at a level of from about 1% to about 20%. In some embodiments, silicates are present at a level of from about 5% to about 15% by weight of the composition.

A detergent composition herein can comprise dispersants. Suitable water-soluble organic materials include, but are not limited to the homo- or co-polymeric acids or their salts, in which the polycarboxylic acid comprises at least two carboxyl radicals separated from each other by not more than two carbon atoms.

Any cellulase disclosed above is contemplated for use in the disclosed detergent compositions. Suitable cellulases include, but are not limited to *Humicola insolens* cellulases (See e.g., U.S. Pat. No. 4,435,307). Exemplary cellulases contemplated for such use are those having color care benefit for a textile. Examples of cellulases that provide a color care benefit are disclosed in EP0495257, EP0531372, EP531315, WO96/11262, WO96/29397, WO94/07998; WO98/12307; WO95/24471, WO98/08940, and U.S. Pat. Nos. 5,457,046, 5,686,593 and 5,763,254, all of which are incorporated herein by reference. Examples of commercially available cellulases useful in a detergent include CELLUSOFT®, CELLUCLEAN®, CELLUZYME®, and CAREZYME® (Novo Nordisk A/S and Novozymes A/S); CLAZINASE®, PURADAX HA®, and REVITALENZ™ (DuPont Industrial Biosciences); BIOTOUCH® (AB Enzymes); and KAC-500(B)™ (Kao Corporation). Additional cellulases are disclosed in, e.g., U.S. Pat. Nos. 7,595,182, 8,569,033, 7,138,263, 3,844,890, 4,435,307, 4,435,307, and GB2095275.

A detergent composition herein may additionally comprise one or more other enzymes in addition to at least one cellulase. Examples of other enzymes include proteases, cellulases, hemicellulases, peroxidases, lipolytic enzymes (e.g., metallolipolytic enzymes), xylanases, lipases, phospholipases, esterases (e.g., arylesterase, polyesterase), perhydrolases, cutinases, pectinases, pectate lyases, mannanases, keratinases, reductases, oxidases (e.g., choline oxidase, phenoloxidase), phenoloxidases, lipoxygenases, ligninases, pullulanases, tannases, pentosanases, malanases, beta-glucanases, arabinosidases, hyaluronidases, chondroitinases, laccases, metalloproteinases, amadoriases, glucoamylases, alpha-amylases, beta-amylases, galactosidases, galactanases, catalases, carageenases, hyaluronidases, keratinases, lactases, ligninases, peroxidases, phosphatases, polygalacturonases, pullulanases, rhamnogalactouronases, tannases, transglutaminases, xyloglucanases, xylosidases, metalloproteases, arabinofuranosidases, phytases, isomerases, transferases and/or amylasesin any combination.

In some embodiments, the detergent compositions can comprise one or more enzymes, each at a level from about 0.00001% to about 10% by weight of the composition and the balance of cleaning adjunct materials by weight of composition. In some other embodiments, the detergent compositions also comprise each enzyme at a level of about 0.0001% to about 10%, about 0.001% to about 5%, about 0.001% to about 2%, about 0.005% to about 0.5% enzyme by weight of the composition.

Suitable proteases include those of animal, vegetable or microbial origin. In some embodiments, microbial proteases are used. In some embodiments, chemically or genetically modified mutants are included. In some embodiments, the protease is a serine protease, preferably an alkaline microbial protease or a trypsin-like protease. Examples of alkaline proteases include subtilisins, especially those derived from *Bacillus* (e.g., subtilisin, *lentus, amyloliquefaciens*, subtilisin Carlsberg, subtilisin 309, subtilisin 147 and subtilisin 168). Additional examples include those mutant proteases described in U.S. Pat. Nos. RE 34,606, 5,955,340, 5,700,676, 6,312,936, and 6,482,628, all of which are incorporated herein by reference. Additional protease examples include, but are not limited to trypsin (e.g., of porcine or bovine origin), and the *Fusarium* protease described in WO 89/06270. In some embodiments, commercially available protease enzymes that find use in the present disclosure include, but are not limited to MAXATASE®, MAXACAL™, MAXAPEM™, OPTICLEAN®, OPTIMASE®, PROPERASE®, PURAFECT®, PURAFECT® OXP, PURAMAX™, EXCELLASE™, PREFERENZ™ proteases (e.g. P100, P110, P280), EFFECTENZ™ proteases (e.g. P1000, P1050, P2000), EXCELLENZ™ proteases (e.g. P1000), ULTIMASE®, and PURAFAST™ (Genencor); ALCALASE®, SAVINASE®, PRIMASE®, DURAZYM™, POLARZYME®, OVOZYME®, KANNASE®, LIQUANASE®, NEUTRASE®, RELASE® and ESPERASE® (Novozymes); BLAP™ and BLAP™ variants (Henkel Kommanditgesellschaft auf Aktien, Duesseldorf, Germany), and KAP (*B. alkalophilus* subtilisin; Kao Corp., Tokyo, Japan). Various proteases are described in WO95/23221, WO 92/21760, WO 09/149200, WO 09/149144, WO 09/149145, WO 11/072099, WO 10/056640, WO 10/056653, WO 11/140364, WO 12/151534, U.S. Pat. Publ. No. 2008/0090747, and U.S. Pat. Nos. 5,801,039, 5,340,735, 5,500,364, 5,855,625, US RE 34,606, 5,955,340, 5,700,676, 6,312,936, 6,482,628, 8,530,219, and various other patents. In some further embodiments, neutral metalloproteases find use in the present disclosure, including but not limited to the neutral metalloproteases described in WO1999014341, WO1999033960, WO1999014342, WO1999034003, WO2007044993, WO2009058303, WO2009058661. Exemplary metalloproteases include nprE, the recombinant form of neutral metalloprotease expressed in *Bacillus subtilis* (See e.g., WO 07/044993), and PMN, the purified neutral metalloprotease from *Bacillus amyloliquefaciens*.

Suitable mannanases include, but are not limited to those of bacterial or fungal origin. Chemically or genetically modified mutants are included in some embodiments. Various mannanases are known which find use in the present disclosure (See e.g., U.S. Pat. Nos. 6,566,114, 6,602,842, and 6,440,991, all of which are incorporated herein by reference). Commercially available mannanases that find use in the present disclosure include, but are not limited to MANNASTAR®, PURABRITE™, and MANNAWAY®.

Suitable lipases include those of bacterial or fungal origin. Chemically modified, proteolytically modified, or protein engineered mutants are included. Examples of useful lipases include those from the genera *Humicola* (e.g., *H. lanuginosa*, EP258068 and EP305216; *H. insolens*, WO96/13580), *Pseudomonas* (e.g., *P. alcaligenes* or *P. pseudoalcaligenes*, EP218272; *P. cepacia*, EP331376; *P. stutzeri*, GB1372034; *P. fluorescens* and *Pseudomonas* sp. strain SD 705, WO95/06720 and WO96/27002; *P. wisconsinensis*, WO96/12012); and *Bacillus* (e.g., *B. subtilis*, Dartois et al., *Biochemica et Biophysica Acta* 1131:253-360; *B. stearothermophilus*, JP64/744992; *B. pumilus*, WO91/16422). Furthermore, a number of cloned lipases find use in some embodiments, including but not limited to *Penicillium camembertii* lipase (See, Yamaguchi et al., Gene 103:61-67 [1991]), *Geotricum candidum* lipase (See, Schimada et al., J. Biochem., 106: 383-388 [1989]), and various *Rhizopus* lipases such as *R. delemar* lipase (See, Hass et al., *Gene* 109:117-113 [1991]), a *R. niveus* lipase (Kugimiya et al., Biosci. Biotech. Biochem. 56:716-719 [1992]) and *R. oryzae* lipase. Additional lipases useful herein include, for example, those disclosed in WO92/05249, WO94/01541, WO95/35381, WO96/00292, WO95/30744, WO94/25578, WO95/14783, WO95/22615, WO97/04079, WO97/07202, EP407225 and EP260105. Other types of lipase polypeptide enzymes such as cutinases also find use in some embodiments, including but not limited to the cutinase derived from *Pseudomonas mendocina* (See, WO 88/09367), and the cutinase derived from *Fusarium solani pisi* (See, WO 90/09446).Examples of certain commercially available lipase enzymes useful herein include M1 LIPASE™, LUMA FAST™, and LIPOMAX™ (Genencor); LIPEX®, LIPOLASE® and LIPOLASE® ULTRA (Novozymes); and LIPASE P™ "Amano" (Amano Pharmaceutical Co. Ltd., Japan).

Suitable polyesterases include, for example, those disclosed in WO01/34899, WO01/14629 and U.S. Pat. No. 6,933,140.

A detergent composition herein can also comprise 2,6-beta-D-fructan hydrolase, which is effective for removal/cleaning of certain biofilms present on household and/or industrial textiles/laundry.

Suitable amylases include, but are not limited to those of bacterial or fungal origin. Chemically or genetically modified mutants are included in some embodiments. Amylases that find use in the present disclosure, include, but are not limited to α-amylases obtained from *B. licheniformis* (See e.g., GB 1,296,839). Additional suitable amylases include those found in WO9510603, WO9526397, WO9623874, WO9623873, WO9741213, WO9919467, WO0060060, WO0029560, WO9923211, WO9946399, WO0060058, WO0060059, WO9942567, WO0114532, WO02092797, WO0166712, WO0188107, WO0196537, WO0210355, WO9402597, WO0231124, WO9943793, WO9943794, WO2004113551, WO2005001064, WO2005003311, WO0164852, WO2006063594, WO2006066594, WO2006066596, WO2006012899, WO2008092919, WO2008000825, WO2005018336, WO2005066338, WO2009140504, WO2005019443, WO2010091221, WO2010088447, WO0134784, WO2006012902, WO2006031554, WO2006136161, WO2008101894, WO2010059413, WO2011098531, WO2011080352, WO2011080353, WO2011080354, WO2011082425, WO2011082429, WO2011076123, WO2011087836, WO2011076897, WO94183314, WO9535382, WO9909183, WO9826078, WO9902702, WO9743424, WO9929876, WO9100353, WO9605295, WO9630481, WO9710342, WO2008088493, WO2009149419, WO2009061381, WO2009100102, WO2010104675, WO2010117511, and WO2010115021.

Suitable amylases include, for example, commercially available amylases such as STAINZYME®, STAINZYME PLUS®, NATALASE®, DURAMYL®, TERMAMYL®, TERMAMYL ULTRA®, FUNGAMYL® and BAN™ (Novo Nordisk NS and Novozymes A/S); RAPIDASE®, POWERASE®, PURASTAR® and PREFERENZ™ (DuPont Industrial Biosciences).

Suitable peroxidases/oxidases contemplated for use in the compositions include those of plant, bacterial or fungal origin. Chemically modified or protein engineered mutants are included. Examples of peroxidases useful herein include those from the genus *Coprinus* (e.g., *C. cinereus*, WO93/24618, WO95/10602, and WO98/15257), as well as those referenced in WO 2005056782, WO2007106293, WO2008063400, WO2008106214, and WO2008106215. Commercially available peroxidases useful herein include, for example, GUARDZYME™ (Novo Nordisk A/S and Novozymes A/S).

In some embodiments, peroxidases are used in combination with hydrogen peroxide or a source thereof (e.g., a percarbonate, perborate or persulfate) in the compositions of the present disclosure. In some alternative embodiments, oxidases are used in combination with oxygen. Both types of enzymes are used for "solution bleaching" (i.e., to prevent transfer of a textile dye from a dyed fabric to another fabric when the fabrics are washed together in a wash liquor), preferably together with an enhancing agent (See e.g., WO 94/12621 and WO 95/01426). Suitable peroxidases/oxidases include, but are not limited to those of plant, bacterial or fungal origin. Chemically or genetically modified mutants are included in some embodiments.

Enzymes that may be comprised in a detergent composition herein may be stabilized using conventional stabilizing agents, e.g., a polyol such as propylene glycol or glycerol; a sugar or sugar alcohol; lactic acid; boric acid or a boric acid derivative (e.g., an aromatic borate ester).

A detergent composition herein may contain about 1 wt % to about 65 wt % of a detergent builder or complexing agent such as zeolite, diphosphate, triphosphate, phosphonate, citrate, nitrilotriacetic acid (NTA), ethylenediaminetetraacetic acid (EDTA), diethylenetriaminepentaacetic acid (DTMPA), alkyl- or alkenylsuccinic acid, soluble silicates or layered silicates (e.g., SKS-6 from Hoechst). A detergent may also be unbuilt, i.e., essentially free of detergent builder.

A detergent composition in certain embodiments may comprise one or more other types of polymers in addition to the present α-glucan oligomers/polymers and/or the present α-glucan ether compounds. Examples of other types of polymers useful herein include carboxymethyl cellulose (CMC), poly(vinylpyrrolidone) (PVP), polyethylene glycol (PEG), poly(vinyl alcohol) (PVA), polycarboxylates such as polyacrylates, maleic/acrylic acid copolymers and lauryl methacrylate/acrylic acid copolymers.

A detergent composition herein may contain a bleaching system. For example, a bleaching system can comprise an $H_2O_2$ source such as perborate or percarbonate, which may be combined with a peracid-forming bleach activator such as tetraacetylethylenediamine (TAED) or nonanoyloxybenzenesulfonate (NOBS). Alternatively, a bleaching system may comprise peroxyacids (e.g., amide, imide, or sulfone type peroxyacids). Alternatively still, a bleaching system can be an enzymatic bleaching system comprising perhydrolase, for example, such as the system described in WO2005/056783.

A detergent composition herein may also contain conventional detergent ingredients such as fabric conditioners, clays, foam boosters, suds suppressors, anti-corrosion agents, soil-suspending agents, anti-soil redeposition agents, dyes, bactericides, tarnish inhibiters, optical brighteners, or perfumes. The pH of a detergent composition herein (measured in aqueous solution at use concentration) is usually neutral or alkaline (e.g., pH of about 7.0 to about 11.0).

Particular forms of detergent compositions that can be adapted for purposes disclosed herein are disclosed in, for example, US20090209445A1, US20100081598A1, U.S. Pat. No. 7,001,878B2, EP1504994B1, WO2001085888A2, WO2003089562A1, WO2009098659A1, WO2009098660A1, WO2009112992A1, WO2009124160A1, WO2009152031A1, WO2010059483A1, WO2010088112A1, WO2010090915A1, WO2010135238A1, WO2011094687A1, WO2011094690A1, WO2011127102A1, WO2011163428A1, WO2008000567A1, WO2006045391A1, WO2006007911A1, WO2012027404A1, EP174069061, WO2012059336A1, U.S. Pat. No. 6,730,646B1, WO2008087426A1, WO2010116139A1, and WO2012104613A1, all of which are incorporated herein by reference.

Laundry detergent compositions herein can optionally be heavy duty (all purpose) laundry detergent compositions. Exemplary heavy duty laundry detergent compositions comprise a detersive surfactant (10%-40% wt/wt), including an anionic detersive surfactant (selected from a group of linear or branched or random chain, substituted or unsubstituted alkyl sulphates, alkyl sulphonates, alkyl alkoxylated sulphate, alkyl phosphates, alkyl phosphonates, alkyl carboxylates, and/or mixtures thereof), and optionally non-ionic surfactant (selected from a group of linear or branched or random chain, substituted or unsubstituted alkyl alkoxylated alcohol, e.g., C8-C18 alkyl ethoxylated alcohols and/or C6-C12 alkyl phenol alkoxylates), where the weight ratio of anionic detersive surfactant (with a hydrophilic index (HIc) of from 6.0 to 9) to non-ionic detersive surfactant is greater than 1:1. Suitable detersive surfactants also include cationic detersive surfactants (selected from a group of alkyl pyridinium compounds, alkyl quaternary ammonium compounds, alkyl quaternary phosphonium compounds, alkyl ternary sulphonium compounds, and/or mixtures thereof); zwitterionic and/or amphoteric detersive surfactants (selected from a group of alkanolamine sulpho-betaines); ampholytic surfactants; semi-polar non-ionic surfactants and mixtures thereof.

A detergent herein such as a heavy duty laundry detergent composition may optionally include, a surfactancy boosting polymer consisting of amphiphilic alkoxylated grease cleaning polymers (selected from a group of alkoxylated polymers having branched hydrophilic and hydrophobic properties, such as alkoxylated polyalkylenimines in the range of 0.05 wt %-10 wt %) and/or random graft polymers (typically comprising of hydrophilic backbone comprising monomers selected from the group consisting of: unsaturated C1-C6 carboxylic acids, ethers, alcohols, aldehydes, ketones, esters, sugar units, alkoxy units, maleic anhydride, saturated polyalcohols such as glycerol, and mixtures thereof; and hydrophobic side chain(s) selected from the group consisting of: C4-C25 alkyl group, polypropylene, polybutylene, vinyl ester of a saturated C1-C6 mono-carboxylic acid, C1-C6 alkyl ester of acrylic or methacrylic acid, and mixtures thereof.

A detergent herein such as a heavy duty laundry detergent composition may optionally include additional polymers such as soil release polymers (include anionically end-capped polyesters, for example SRP1, polymers comprising at least one monomer unit selected from saccharide, dicarboxylic acid, polyol and combinations thereof, in random or block configuration, ethylene terephthalate-based polymers and copolymers thereof in random or block configuration, for example REPEL-O-TEX SF, SF-2 AND SRP6, TEXCARE SRA100, SRA300, SRN100, SRN170, SRN240, SRN300 AND SRN325, MARLOQUEST SL), anti-redeposition polymers (0.1 wt % to 10 wt %), include carboxylate polymers, such as polymers comprising at least one monomer selected from acrylic acid, maleic acid (or maleic anhydride), fumaric acid, itaconic acid, aconitic acid, mesaconic acid, citraconic acid, methylenemalonic acid, and any mixture thereof, vinylpyrrolidone homopolymer, and/or polyethylene glycol, molecular weight in the range of from 500 to 100,000 Da); and polymeric carboxylate (such as maleate/acrylate random copolymer or polyacrylate homopolymer).

A detergent herein such as a heavy duty laundry detergent composition may optionally further include saturated or unsaturated fatty acids, preferably saturated or unsaturated C12-C24 fatty acids (0 wt % to 10 wt %); deposition aids in addition to the α-glucan ether compound disclosed herein (examples for which include polysaccharides, cellulosic polymers, poly diallyl dimethyl ammonium halides (DADMAC), and copolymers of DAD MAC with vinyl pyrrolidone, acrylamides, imidazoles, imidazolinium halides, and mixtures thereof, in random or block configuration, cationic guar gum, cationic starch, cationic polyacrylamides, and mixtures thereof.

A detergent herein such as a heavy duty laundry detergent composition may optionally further include dye transfer inhibiting agents, examples of which include manganese phthalocyanine, peroxidases, polyvinylpyrrolidone polymers, polyamine N-oxide polymers, copolymers of N-vinylpyrrolidone and N-vinylimidazole, polyvinyloxazolidones and polyvinylimidazoles and/or mixtures thereof; chelating agents, examples of which include ethylene-diamine-tetraacetic acid (EDTA), diethylene triamine penta methylene phosphonic acid (DTPMP), hydroxy-ethane diphosphonic acid (HEDP), ethylenediamine N,N'-disuccinic acid (EDDS), methyl glycine diacetic acid (MGDA), diethylene triamine penta acetic acid (DTPA), propylene diamine tetracetic acid (PDTA), 2-hydroxypyridine-N-oxide (HPNO), or methyl glycine diacetic acid (MGDA), glutamic acid N,N-diacetic acid (N,N-dicarboxymethyl glutamic acid tetrasodium salt (GLDA), nitrilotriacetic acid (NTA), 4,5-dihydroxy-m-benzenedisulfonic acid, citric acid and any salts thereof, N-hydroxyethylethylenediaminetriacetic acid (HEDTA), triethylenetetraaminehexaacetic acid (TTHA), N-hydroxyethyliminodiacetic acid (HEIDA), dihydroxyethylglycine (DHEG), ethylenediaminetetrapropionic acid (EDTP), and derivatives thereof.

A detergent herein such as a heavy duty laundry detergent composition may optionally include silicone or fatty-acid based suds suppressors; hueing dyes, calcium and magnesium cations, visual signaling ingredients, anti-foam (0.001 wt % to about 4.0 wt %), and/or a structurant/thickener (0.01 wt % to 5 wt %) selected from the group consisting of diglycerides and triglycerides, ethylene glycol distearate, microcrystalline cellulose, microfiber cellulose, biopolymers, xanthan gum, gellan gum, and mixtures thereof). Such structurant/thickener would be in addition to the one or more of the present α-glucan oligomers/polymers and/or α-glucan ether compounds comprised in the detergent.

A detergent herein can be in the form of a heavy duty dry/solid laundry detergent composition, for example. Such a detergent may include: (i) a detersive surfactant, such as any anionic detersive surfactant disclosed herein, any non-ionic detersive surfactant disclosed herein, any cationic detersive surfactant disclosed herein, any zwitterionic and/or amphoteric detersive surfactant disclosed herein, any ampholytic surfactant, any semi-polar non-ionic surfactant, and mixtures thereof; (ii) a builder, such as any phosphate-free builder (e.g., zeolite builders in the range of 0 wt % to less than 10 wt %), any phosphate builder (e.g., sodium tri-polyphosphate in the range of 0 wt % to less than 10 wt %), citric acid, citrate salts and nitrilotriacetic acid, any silicate salt (e.g., sodium or potassium silicate or sodium meta-silicate in the range of 0 wt % to less than 10 wt %); any carbonate salt (e.g., sodium carbonate and/or sodium bicarbonate in the range of 0 wt % to less than 80 wt %), and mixtures thereof; (iii) a bleaching agent, such as any photobleach (e.g., sulfonated zinc phthalocyanines, sulfonated aluminum phthalocyanines, xanthenes dyes, and mixtures thereof), any hydrophobic or hydrophilic bleach activator (e.g., dodecanoyl oxybenzene sulfonate, decanoyl oxybenzene sulfonate, decanoyl oxybenzoic acid or salts thereof, 3,5,5-trimethyl hexanoyl oxybenzene sulfonate, tetraacetyl ethylene diamine-TAED, nonanoyloxybenzene sulfonate-NOBS, nitrile quats, and mixtures thereof), any source of hydrogen peroxide (e.g., inorganic perhydrate salts, examples of which include mono or tetra hydrate sodium salt of perborate, percarbonate, persulfate, perphosphate, or persilicate), any preformed hydrophilic and/or hydrophobic peracids (e.g., percarboxylic acids and salts, percarbonic acids and salts, perimidic acids and salts, peroxymonosulfuric acids and salts, and mixtures thereof); and/or (iv) any other components such as a bleach catalyst (e.g., imine bleach boosters examples of which include iminium cations and polyions, iminium zwitterions, modified amines, modified amine oxides, N-sulphonyl imines, N-phosphonyl imines, N-acyl imines, thiadiazole dioxides, perfluoroimines, cyclic sugar ketones, and mixtures thereof), and a metal-containing bleach catalyst (e.g., copper, iron, titanium, ruthenium, tungsten, molybdenum, or manganese cations along with an auxiliary metal cations such as zinc or aluminum and a sequestrate such as EDTA, ethylenediaminetetra(methylenephosphonic acid).

Compositions disclosed herein can be in the form of a dishwashing detergent composition. Examples of dishwashing detergents include automatic dishwashing detergents (typically used in dishwasher machines) and hand-washing dish detergents. A dishwashing detergent composition can be in any dry or liquid/aqueous form as disclosed herein, for example. Components that may be included in certain embodiments of a dishwashing detergent composition include, for example, one or more of a phosphate; oxygen- or chlorine-based bleaching agent; non-ionic surfactant; alkaline salt (e.g., metasilicates, alkali metal hydroxides, sodium carbonate); any active enzyme disclosed herein; anti-corrosion agent (e.g., sodium silicate); anti-foaming agent; additives to slow down the removal of glaze and patterns from ceramics; perfume; anti-caking agent (in granular detergent); starch (in tablet-based detergents); gelling agent (in liquid/gel based detergents); and/or sand (powdered detergents).

Dishwashing detergents such as an automatic dishwasher detergent or liquid dishwashing detergent can comprise (i) a non-ionic surfactant, including any ethoxylated non-ionic surfactant, alcohol alkoxylated surfactant, epoxy-capped poly(oxyalkylated) alcohol, or amine oxide surfactant present in an amount from 0 to 10 wt %; (ii) a builder, in the range of about 5-60 wt %, including any phosphate builder (e.g., mono-phosphates, di-phosphates, tri-polyphosphates, other oligomeric-polyphosphates, sodium tripolyphosphate-STPP), any phosphate-free builder (e.g., amino acid-based compounds including methyl-glycine-diacetic acid [MGDA] and salts or derivatives thereof, glutamic-N,N-diacetic acid [GLDA] and salts or derivatives thereof, iminodisuccinic acid (IDS) and salts or derivatives thereof, carboxy methyl inulin and salts or derivatives thereof, nitrilotriacetic acid [NTA], diethylene triamine penta acetic acid [DTPA], B-alaninediacetic acid [B-ADA] and salts thereof), homopolymers and copolymers of poly-carboxylic acids and partially or completely neutralized salts thereof, monomeric polycarboxylic acids and hydroxycarboxylic acids and salts thereof in the range of 0.5 wt % to 50 wt %, or sulfonated/carboxylated polymers in the range of about 0.1 wt % to about 50 wt %; (iii) a drying aid in the range of about 0.1 wt % to about 10 wt % (e.g., polyesters, especially anionic polyesters, optionally together with further monomers with 3 to 6 functionalities—typically acid, alcohol or ester functionalities which are conducive to polycondensation, polycarbonate-, polyurethane- and/or polyurea-polyorganosiloxane compounds or precursor compounds thereof, particularly of the reactive cyclic carbonate and urea type); (iv) a silicate in the range from about 1 wt % to about 20 wt % (e.g., sodium or potassium silicates such as sodium disilicate, sodium meta-silicate and crystalline phyllosilicates); (v) an inorganic bleach (e.g., perhydrate salts such as perborate, percarbonate, perphosphate, persulfate and persilicate salts) and/or an organic bleach (e.g., organic peroxyacids such as diacyl- and tetraacylperoxides, especially diperoxydodecanedioic acid, diperoxytetradecanedioic acid, and diperoxyhexadecanedioic acid); (vi) a bleach activator (e.g., organic peracid precursors in the range from about 0.1 wt % to about 10 wt %) and/or bleach catalyst (e.g., manganese triazacyclononane and related complexes; Co, Cu, Mn, and Fe bispyridylamine and related complexes; and pentamine acetate cobalt(III) and related complexes); (vii) a metal care agent in the range from about 0.1 wt % to 5 wt % (e.g., benzatriazoles, metal salts and complexes, and/or silicates); and/or (viii) any active enzyme disclosed herein in the range from about 0.01 to 5.0 mg of active enzyme per gram of automatic dishwashing detergent composition, and an enzyme stabilizer component (e.g., oligosaccharides, polysaccharides, and inorganic divalent metal salts).

Various examples of detergent formulations comprising at least one α-glucan ether compound (e.g., a carboxyalkyl α-glucan ether such as carboxymethyl α-glucan) are disclosed below (1-19):

1) A detergent composition formulated as a granulate having a bulk density of at least 600 g/L comprising: linear alkylbenzenesulfonate (calculated as acid) at about 7-12 wt %; alcohol ethoxysulfate (e.g., C12-18 alcohol, 1-2 ethylene oxide [EO]) or alkyl sulfate (e.g., C16-18) at about 1-4 wt %; alcohol ethoxylate (e.g., C14-15 alcohol) at about 5-9 wt %; sodium carbonate at about 14-20 wt %; soluble silicate (e.g., $Na_2O2SiO_2$) at about 2-6 wt %; zeolite (e.g., $NaAlSiO_4$) at about 15-22 wt %; sodium sulfate at about 0-6 wt %; sodium citrate/citric acid at about 0-15 wt %; sodium perborate at about 11-18 wt %; TAED at about 2-6 wt %; α-glucan ether up to about 2 wt %; other polymers (e.g., maleic/acrylic acid copolymer, PVP, PEG) at about 0-3 wt %; optionally an enzyme(s) (calculated as pure enzyme protein) at about 0.0001-0.1 wt %; and minor ingredients (e.g., suds suppressors, perfumes, optical brightener, photobleach) at about 0-5 wt %.
2) A detergent composition formulated as a granulate having a bulk density of at least 600 g/L comprising: linear alkylbenzenesulfonate (calculated as acid) at about 6-11 wt %; alcohol ethoxysulfate (e.g., C12-18 alcohol, 1-2 EO) or alkyl sulfate (e.g., C16-18) at about 1-3 wt %; alcohol ethoxylate (e.g., C14-15 alcohol) at about 5-9 wt %; sodium carbonate at about 15-21 wt %; soluble silicate (e.g., $Na_2O2SiO_2$) at about 1-4 wt %; zeolite (e.g., $NaAlSiO_4$) at about 24-34 wt %; sodium sulfate at about 4-10 wt %; sodium citrate/citric acid at about 0-15 wt %; sodium perborate at about 11-18 wt %; TAED at about 2-6 wt %; α-glucan ether up to about 2 wt %; other polymers (e.g., maleic/acrylic acid copolymer, PVP, PEG) at about 1-6 wt %; optionally an enzyme(s) (calculated as pure enzyme protein) at about 0.0001-0.1 wt %; and minor ingredients (e.g., suds suppressors, perfumes, optical brightener, photobleach) at about 0-5 wt %.
3) A detergent composition formulated as a granulate having a bulk density of at least 600 g/L comprising: linear alkylbenzenesulfonate (calculated as acid) at about 5-9 wt %; alcohol ethoxysulfate (e.g., C12-18 alcohol, 7 EO) at about 7-14 wt %; soap as fatty acid (e.g., C16-22 fatty acid) at about 1-3 wt %; sodium carbonate at about 10-17 wt %; soluble silicate (e.g., $Na_2O2SiO_2$) at about 3-9 wt %; zeolite (e.g., $NaAlSiO_4$) at about 23-33 wt %; sodium sulfate at about 0-4 wt %; sodium perborate at about 8-16 wt %; TAED at about 2-8 wt %; phosphonate (e.g., EDTMPA) at about 0-1 wt %; α-glucan ether up to about 2 wt %; other polymers (e.g., maleic/acrylic acid copolymer, PVP, PEG) at about 0-3 wt %; optionally an enzyme(s) (calculated as pure enzyme protein) at about 0.0001-0.1 wt %; and minor ingredients (e.g., suds suppressors, perfumes, optical brightener) at about 0-5 wt %.
4) A detergent composition formulated as a granulate having a bulk density of at least 600 g/L comprising:

linear alkylbenzenesulfonate (calculated as acid) at about 8-12 wt %; alcohol ethoxylate (e.g., C12-18 alcohol, 7 EO) at about 10-25 wt %; sodium carbonate at about 14-22 wt %; soluble silicate (e.g., $Na_2O2SiO_2$) at about 1-5 wt %; zeolite (e.g., $NaAlSiO_4$) at about 25-35 wt %; sodium sulfate at about 0-10 wt %; sodium perborate at about 8-16 wt %; TAED at about 2-8 wt %; phosphonate (e.g., EDTMPA) at about 0-1 wt %; α-glucan ether up to about 2 wt %; other polymers (e.g., maleic/acrylic acid copolymer, PVP, PEG) at about 1-3 wt %; optionally an enzyme(s) (calculated as pure enzyme protein) at about 0.0001-0.1 wt %; and minor ingredients (e.g., suds suppressors, perfumes) at about 0-5 wt %.

5) An aqueous liquid detergent composition comprising: linear alkylbenzenesulfonate (calculated as acid) at about 15-21 wt %; alcohol ethoxylate (e.g., C12-18 alcohol, 7 EO; or C12-15 alcohol, 5 EO) at about 12-18 wt %; soap as fatty acid (e.g., oleic acid) at about 3-13 wt %; alkenylsuccinic acid (C12-14) at about 0-13 wt %; aminoethanol at about 8-18 wt %; citric acid at about 2-8 wt %; phosphonate at about 0-3 wt %; α-glucan ether up to about 2 wt %; other polymers (e.g., PVP, PEG) at about 0-3 wt %; borate at about 0-2 wt %; ethanol at about 0-3 wt %; propylene glycol at about 8-14 wt %; optionally an enzyme(s) (calculated as pure enzyme protein) at about 0.0001-0.1 wt %; and minor ingredients (e.g., dispersants, suds suppressors, perfume, optical brightener) at about 0-5 wt %.

6) An aqueous structured liquid detergent composition comprising: linear alkylbenzenesulfonate (calculated as acid) at about 15-21 wt %; alcohol ethoxylate (e.g., C12-18 alcohol, 7 EO; or C12-15 alcohol, 5 EO) at about 3-9 wt %; soap as fatty acid (e.g., oleic acid) at about 3-10 wt %; zeolite (e.g., $NaAlSiO_4$) at about 14-22 wt %; potassium citrate about 9-18 wt %; borate at about 0-2 wt %; α-glucan ether up to about 2 wt %; other polymers (e.g., PVP, PEG) at about 0-3 wt %; ethanol at about 0-3 wt %; anchoring polymers (e.g., lauryl methacrylate/acrylic acid copolymer, molar ratio 25:1, MW 3800) at about 0-3 wt %; glycerol at about 0-5 wt %; optionally an enzyme(s) (calculated as pure enzyme protein) at about 0.0001-0.1 wt %; and minor ingredients (e.g., dispersants, suds suppressors, perfume, optical brightener) at about 0-5 wt %.

7) A detergent composition formulated as a granulate having a bulk density of at least 600 g/L comprising: fatty alcohol sulfate at about 5-10 wt %, ethoxylated fatty acid monoethanolamide at about 3-9 wt %; soap as fatty acid at about 0-3 wt %; sodium carbonate at about 5-10 wt %; soluble silicate (e.g., $Na_2O2SiO_2$) at about 1-4 wt %; zeolite (e.g., $NaAlSiO_4$) at about 20-40 wt %; sodium sulfate at about 2-8 wt %; sodium perborate at about 12-18 wt %; TAED at about 2-7 wt %; α-glucan ether up to about 2 wt %; other polymers (e.g., maleic/acrylic acid copolymer, PEG) at about 1-5 wt %; optionally an enzyme(s) (calculated as pure enzyme protein) at about 0.0001-0.1 wt %; and minor ingredients (e.g., optical brightener, suds suppressors, perfumes) at about 0-5 wt %.

8) A detergent composition formulated as a granulate comprising: linear alkylbenzenesulfonate (calculated as acid) at about 8-14 wt %; ethoxylated fatty acid monoethanolamide at about 5-11 wt %; soap as fatty acid at about 0-3 wt %; sodium carbonate at about 4-10 wt %; soluble silicate (e.g., $Na_2O2SiO_2$) at about 1-4 wt %; zeolite (e.g., $NaAlSiO_4$) at about 30-50 wt %; sodium sulfate at about 3-11 wt %; sodium citrate at about 5-12 wt %; α-glucan ether up to about 2 wt %; other polymers (e.g., PVP, maleic/acrylic acid copolymer, PEG) at about 1-5 wt %; optionally an enzyme(s) (calculated as pure enzyme protein) at about 0.0001-0.1 wt %; and minor ingredients (e.g., suds suppressors, perfumes) at about 0-5 wt %.

9) A detergent composition formulated as a granulate comprising: linear alkylbenzenesulfonate (calculated as acid) at about 6-12 wt %; nonionic surfactant at about 1-4 wt %; soap as fatty acid at about 2-6 wt %; sodium carbonate at about 14-22 wt %; zeolite (e.g., $NaAlSiO_4$) at about 18-32 wt %; sodium sulfate at about 5-20 wt %; sodium citrate at about 3-8 wt %; sodium perborate at about 4-9 wt %; bleach activator (e.g., NOBS or TAED) at about 1-5 wt %; α-glucan ether up to about 2 wt %; other polymers (e.g., polycarboxylate or PEG) at about 1-5 wt %; optionally an enzyme(s) (calculated as pure enzyme protein) at about 0.0001-0.1 wt %; and minor ingredients (e.g., optical brightener, perfume) at about 0-5 wt %.

10) An aqueous liquid detergent composition comprising: linear alkylbenzenesulfonate (calculated as acid) at about 15-23 wt %; alcohol ethoxysulfate (e.g., C12-15 alcohol, 2-3 EO) at about 8-15 wt %; alcohol ethoxylate (e.g., C12-15 alcohol, 7 EO; or C12-15 alcohol, 5 EO) at about 3-9 wt %; soap as fatty acid (e.g., lauric acid) at about 0-3 wt %; aminoethanol at about 1-5 wt %; sodium citrate at about 5-10 wt %; hydrotrope (e.g., sodium toluenesulfonate) at about 2-6 wt %; borate at about 0-2 wt %; α-glucan ether up to about 1 wt %; ethanol at about 1-3 wt %; propylene glycol at about 2-5 wt %; optionally an enzyme(s) (calculated as pure enzyme protein) at about 0.0001-0.1 wt %; and minor ingredients (e.g., dispersants, perfume, optical brighteners) at about 0-5 wt %.

11) An aqueous liquid detergent composition comprising: linear alkylbenzenesulfonate (calculated as acid) at about 20-32 wt %; alcohol ethoxylate (e.g., C12-15 alcohol, 7 EO; or C12-15 alcohol, 5 EO) at about 6-12 wt %; aminoethanol at about 2-6 wt %; citric acid at about 8-14 wt %; borate at about 1-3 wt %; α-glucan ether up to about 2 wt %; ethanol at about 1-3 wt %; propylene glycol at about 2-5 wt %; other polymers (e.g., maleic/acrylic acid copolymer, anchoring polymer such as lauryl methacrylate/acrylic acid copolymer) at about 0-3 wt %; glycerol at about 3-8 wt %; optionally an enzyme(s) (calculated as pure enzyme protein) at about 0.0001-0.1 wt %; and minor ingredients (e.g., hydrotropes, dispersants, perfume, optical brighteners) at about 0-5 wt %.

12) A detergent composition formulated as a granulate having a bulk density of at least 600 g/L comprising: anionic surfactant (e.g., linear alkylbenzenesulfonate, alkyl sulfate, alpha-olefinsulfonate, alpha-sulfo fatty acid methyl esters, alkanesulfonates, soap) at about 25-40 wt %; nonionic surfactant (e.g., alcohol ethoxylate) at about 1-10 wt %; sodium carbonate at about 8-25 wt %; soluble silicate (e.g., $Na_2O2SiO_2$) at about 5-15 wt %; sodium sulfate at about 0-5 wt %; zeolite ($NaAlSiO_4$) at about 15-28 wt %; sodium perborate at about 0-20 wt %; bleach activator (e.g., TAED or NOBS) at about 0-5 wt %; α-glucan ether up to about 2 wt %; optionally an enzyme(s) (calculated as pure enzyme protein) at about 0.0001-0.1 wt %; and minor ingredients (e.g., perfume, optical brighteners) at about 0-3 wt %.

13) Detergent compositions as described in (1)-(12) above, but in which all or part of the linear alkylbenzenesulfonate is replaced by C12-C18 alkyl sulfate.

14) A detergent composition formulated as a granulate having a bulk density of at least 600 g/L comprising: C12-C18 alkyl sulfate at about 9-15 wt %; alcohol ethoxylate at about 3-6 wt %; polyhydroxy alkyl fatty acid amide at about 1-5 wt %; zeolite (e.g., $NaAlSiO_4$) at about 10-20 wt %; layered disilicate (e.g., SK56 from Hoechst) at about 10-20 wt %; sodium carbonate at about 3-12 wt %; soluble silicate (e.g., $Na_2O2SiO_2$) at 0-6 wt %; sodium citrate at about 4-8 wt %; sodium percarbonate at about 13-22 wt %; TAED at about 3-8 wt %; α-glucan ether up to about 2 wt %; other polymers (e.g., polycarboxylates and PVP) at about 0-5 wt %; optionally an enzyme(s) (calculated as pure enzyme protein) at about 0.0001-0.1 wt %; and minor ingredients (e.g., optical brightener, photobleach, perfume, suds suppressors) at about 0-5 wt %.

15) A detergent composition formulated as a granulate having a bulk density of at least 600 g/L comprising: C12-C18 alkyl sulfate at about 4-8 wt %; alcohol ethoxylate at about 11-15 wt %; soap at about 1-4 wt %; zeolite MAP or zeolite A at about 35-45 wt %; sodium carbonate at about 2-8 wt %; soluble silicate (e.g., $Na_2O2SiO_2$) at 0-4 wt %; sodium percarbonate at about 13-22 wt %; TAED at about 1-8 wt %; α-glucan ether up to about 3 wt %; other polymers (e.g., polycarboxylates and PVP) at about 0-3 wt %; optionally an enzyme(s) (calculated as pure enzyme protein) at about 0.0001-0.1 wt %; and minor ingredients (e.g., optical brightener, phosphonate, perfume) at about 0-3 wt %.

16) Detergent formulations as described in (1)-(15) above, but that contain a stabilized or encapsulated peracid, either as an additional component or as a substitute for an already specified bleach system(s).

17) Detergent compositions as described in (1), (3), (7), (9) and (12) above, but in which perborate is replaced by percarbonate.

18) Detergent compositions as described in (1), (3), (7), (9), (12), (14) and (15) above, but that additionally contain a manganese catalyst. A manganese catalyst, for example, is one of the compounds described by Hage et al. (1994, *Nature* 369:637-639), which is incorporated herein by reference.

19) Detergent compositions formulated as a non-aqueous detergent liquid comprising a liquid non-ionic surfactant (e.g., a linear alkoxylated primary alcohol), a builder system (e.g., phosphate), α-glucan ether, optionally an enzyme(s), and alkali. The detergent may also comprise an anionic surfactant and/or bleach system.

In another embodiment, the present α-glucan oligomers/polymers (non-derivatized) may be partially or completely substituted for the α-glucan ether component in any of the above exemplary formulations.

It is believed that numerous commercially available detergent formulations can be adapted to include a poly alpha-1,3-1,6-glucan ether compound. Examples include PUREX® ULTRAPACKS (Henkel), FINISH® QUANTUM (Reckitt Benckiser), CLOROX™ 2 PACKS (Clorox), OXICLEAN MAX FORCE POWER PAKS (Church & Dwight), TIDE® STAIN RELEASE, CASCADE® ACTIONPACS, and TIDE® PODS™ (Procter & Gamble).

In a further embodiment to any of the above embodiments, a personal care composition, a fabric care composition or a laundry care composition is provided comprising the glucan ether composition described in any of the preceeding embodiments.

The present α-glucan oligomer/polymer composition and/or the present α-glucan ether composition may be applied as a surface substantive treatment to a fabric, yarn or fiber. In yet a further embodiment, a fabric, yarn or fiber is provided comprising the present α-glucan oligomer/polymer composition, the present α-glucan ether composition, or a combination thereof.

The α-glucan ether compound disclosed herein may be used to alter viscosity of an aqueous composition. The α-glucan ether compound herein can have a relatively low DoS and still be an effective viscosity modifier. It is believed that the viscosity modification effect of the disclosed α-glucan ether compounds may be coupled with a rheology modification effect. It is further believed that, by contacting a hydrocolloid or aqueous solution herein with a surface (e.g., fabric surface), one or more α-glucan ether compounds and/or the present α-glucan oligomer/polymer composition, the compounds will adsorb to the surface.

In another embodiment, a method for preparing an aqueous composition, the method is provided comprising: contacting an aqueous composition with the present α-glucan ether compound wherein the aqueous composition comprises a cellulase, a protease or a combination thereof.

In another embodiment, a method to produce a glucan ether composition is provided comprising:

a) Providing an α-glucan oligomer/polymer composition comprising:
   i. at least 75% α-(1,3) glycosidic linkages;
   ii. less than 25% α-(1,6) glycosidic linkages;
   iii. less than 10% α-(1,3,6) glycosidic linkages;
   iv. a weight average molecular weight of less than 5000 Daltons;
   v. a viscosity of less than 0.25 Pascal second (Pa·s) at 12 wt % in water 20° C.;
   vi. a solubility of at least 20% (w/w) in water at 25° C.; and
   vii. a polydispersity index of less than 5;
b) contacting the α-glucan oligomer/polymer composition of (a) in a reaction under alkaline conditions with at least one etherification agent comprising an organic group; whereby an α-glucan ether is produced has a degree of substitution (DoS) with at least one organic group of about 0.05 to about 3.0; and
c) optionally isolating the α-glucan ether produced in step (b).

In another embodiment, a method of treating an article of clothing, textile or fabric is provided comprising:

a) providing a composition selected from
   1) a fabric care composition as described above;
   2) a laundry care composition as described above;
   3) an α-glucan ether composition as described above;
   4) an α-glucan oligomer/polymer composition comprising:
      i. at least 75% α-(1,3) glycosidic linkages;
      ii. less than 25% α-(1,6) glycosidic linkages;
      iii. less than 10% α-(1,3,6) glycosidic linkages;
      iv. a weight average molecular weight of less than 5000 Daltons;
      v. a viscosity of less than 0.25 Pascal second (Pa·s) at 12 wt % in water 20° C.;

vi. a solubility of at least 20% (w/w) in water at 25° C.; and vii. a polydispersity index of less than 5; and 5) any combination of (i) through (iv).

b) contacting under suitable conditions the composition of (a) with a fabric, textile or article of clothing whereby the fabric, textile or article of clothing is treated and receives a benefit;

c) optionally rinsing the treated fabric or article of clothing of (b).

In a preferred embodiment of the above method, the composition of (a) is cellulase resistant, protease resistant or a combination thereof.

In another embodiment to the above method, the α-glucan oligomer/polymer composition and/or the α-glucan ether composition is a surface substantive.

In another embodiment to any of the above methods, the benefit is selected from the group consisting of improved fabric hand, improved resistance to soil deposition, improved colorfastness, improved wear resistance, improved wrinkle resistance, improved antifungal activity, improved stain resistance, improved cleaning performance when laundered, improved drying rates, improved dye, pigment or lake update, and any combination thereof.

A fabric herein can comprise natural fibers, synthetic fibers, semi-synthetic fibers, or any combination thereof. A semi-synthetic fiber herein is produced using naturally occurring material that has been chemically derivatized, an example of which is rayon. Non-limiting examples of fabric types herein include fabrics made of (i) cellulosic fibers such as cotton (e.g., broadcloth, canvas, chambray, chenille, chintz, corduroy, cretonne, damask, denim, flannel, gingham, jacquard, knit, matelassé, oxford, percale, poplin, plissé, sateen, seersucker, sheers, terry cloth, twill, velvet), rayon (e.g., viscose, modal, lyocell), linen, and TENCEL®; (ii) proteinaceous fibers such as silk, wool and related mammalian fibers; (iii) synthetic fibers such as polyester, acrylic, nylon, and the like; (iv) long vegetable fibers from jute, flax, ramie, coir, kapok, sisal, henequen, abaca, hemp and sunn; and (v) any combination of a fabric of (i)-(iv). Fabric comprising a combination of fiber types (e.g., natural and synthetic) include those with both a cotton fiber and polyester, for example. Materials/articles containing one or more fabrics herein include, for example, clothing, curtains, drapes, upholstery, carpeting, bed linens, bath linens, tablecloths, sleeping bags, tents, car interiors, etc. Other materials comprising natural and/or synthetic fibers include, for example, non-woven fabrics, paddings, paper, and foams.

An aqueous composition that is contacted with a fabric can be, for example, a fabric care composition (e.g., laundry detergent, fabric softener or other fabric treatment composition). Thus, a treatment method in certain embodiments can be considered a fabric care method or laundry method if employing a fabric care composition therein. A fabric care composition herein can effect one or more of the following fabric care benefits: improved fabric hand, improved resistance to soil deposition, improved soil release, improved colorfastness, improved fabric wear resistance, improved wrinkle resistance, improved wrinkle removal, improved shape retention, reduction in fabric shrinkage, pilling reduction, improved antifungal activity, improved stain resistance, improved cleaning performance when laundered, improved drying rates, improved dye, pigment or lake update, and any combination thereof.

Examples of conditions (e.g., time, temperature, wash/rinse volumes) for conducting a fabric care method or laundry method herein are disclosed in WO1997/003161 and U.S. Pat. Nos. 4,794,661, 4,580,421 and 5,945,394, which are incorporated herein by reference. In other examples, a material comprising fabric can be contacted with an aqueous composition herein: (i) for at least about 5, 10, 20, 30, 40, 50, 60, 70, 80, 90, 100, 110, or 120 minutes; (ii) at a temperature of at least about 10, 15, 20, 25, 30, 35, 40, 45, 50, 55, 60, 65, 70, 75, 80, 85, 90, or 95° C. (e.g., for laundry wash or rinse: a "cold" temperature of about 15-30° C., a "warm" temperature of about 30-50° C., a "hot" temperature of about 50-95° C.); (iii) at a pH of about 2, 3, 4, 5, 6, 7, 8, 9, 10, 11, or 12 (e.g., pH range of about 2-12, or about 3-11); (iv) at a salt (e.g., NaCl) concentration of at least about 0.5, 1.0, 1.5, 2.0, 2.5, 3.0, 3.5, or 4.0 wt %; or any combination of (i)-(iv). The contacting step in a fabric care method or laundry method can comprise any of washing, soaking, and/or rinsing steps, for example.

In certain embodiments of treating a material comprising fabric, the present α-glucan oligomers/polymers and/or the present α-glucan ether compound component(s) of the aqueous composition adsorbs to the fabric. This feature is believed to render the compounds useful as anti-redeposition agents and/or anti-greying agents in fabric care compositions disclosed herein (in addition to their viscosity-modifying effect). An anti-redeposition agent or anti-greying agent herein helps keep soil from redepositing onto clothing in wash water after the soil has been removed. It is further contemplated that adsorption of one or more of the present compounds herein to a fabric enhances mechanical properties of the fabric.

Adsorption of the present α-glucan oligomers/polymer and/or the present α-glucan ethers to a fabric herein can be measured following the methodology disclosed in the below Examples, for example. Alternatively, adsorption can be measured using a colorimetric technique (e.g., Dubois et al., 1956, *Anal. Chem.* 28:350-356; Zemljič et al., 2006, *Lenzinger Berichte* 85:68-76; both incorporated herein by reference) or any other method known in the art.

Other materials that can be contacted in the above treatment method include surfaces that can be treated with a dish detergent (e.g., automatic dishwashing detergent or hand dish detergent). Examples of such materials include surfaces of dishes, glasses, pots, pans, baking dishes, utensils and flatware made from ceramic material, china, metal, glass, plastic (e.g., polyethylene, polypropylene, polystyrene, etc.) and wood (collectively referred to herein as "tableware"). Thus, the treatment method in certain embodiments can be considered a dishwashing method or tableware washing method, for example. Examples of conditions (e.g., time, temperature, wash volume) for conducting a dishwashing or tableware washing method herein are disclosed in U.S. Pat. No. 8,575,083, which is incorporated herein by reference. In other examples, a tableware article can be contacted with an aqueous composition herein under a suitable set of conditions such as any of those disclosed above with regard to contacting a fabric-comprising material.

Certain embodiments of a method of treating a material herein further comprise a drying step, in which a material is dried after being contacted with the aqueous composition. A drying step can be performed directly after the contacting step, or following one or more additional steps that might follow the contacting step (e.g., drying of a fabric after being rinsed, in water for example, following a wash in an aqueous composition herein). Drying can be performed by any of several means known in the art, such as air drying (e.g., —20-25° C.), or at a temperature of at least about 30, 40, 50, 60, 70, 80, 90, 100, 120, 140, 160, 170, 175, 180, or 200° C., for example. A material that has been dried herein typically has less than 3, 2, 1, 0.5, or 0.1 wt % water comprised therein. Fabric is a preferred material for conducting an optional drying step.

An aqueous composition used in a treatment method herein can be any aqueous composition disclosed herein, such as in the above embodiments or in the below Examples. Examples of aqueous compositions include detergents (e.g., laundry detergent or dish detergent) and water-containing dentifrices such as toothpaste.

In another embodiment, a method to alter the viscosity of an aqueous composition is provided comprising contacting one or more of the present α-glucan ether compounds with the aqueous composition, wherein the presence of the one or more α-glucan ether compounds alters (increases or decreases) the viscosity of the aqueous composition.

In a preferred aspect, the alteration in viscosity can be an increase and/or decrease of at least about 1%, 10%, 100%, 1000%, 100000%, or 1000000% (or any integer between 1% and 1000000%), for example, compared to the viscosity of the aqueous composition before the contacting step.

Etherification of the Present α-Glucan Oligomers/Polymers

The following steps can be taken to prepare the above etherification reaction.

The present α-glucan oligomers/polymers are contacted under alkaline conditions with at least one etherification agent comprising an organic group. This step can be performed, for example, by first preparing alkaline conditions by contacting the present α-glucan oligomers/polymers with a solvent and one or more alkali hydroxides to provide a mixture (e.g., slurry) or solution. The alkaline conditions of the etherification reaction can thus comprise an alkali hydroxide solution. The pH of the alkaline conditions can be at least about 11.0, 11.2, 11.4, 11.6, 11.8, 12.0, 12.2, 12.4, 12.6, 12.8, or 13.0.

Various alkali hydroxides can be used, such as sodium hydroxide, potassium hydroxide, calcium hydroxide, lithium hydroxide, and/or tetraethylammonium hydroxide. The concentration of alkali hydroxide in a preparation with the present α-glucan oligomers/polymers and a solvent can be from about 1-70 wt %, 5-50 wt %, 5-10 wt %, 10-50 wt %, 10-40 wt %, or 10-30 wt % (or any integer between 1 and 70 wt %). Alternatively, the concentration of alkali hydroxide such as sodium hydroxide can be at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 wt %. An alkali hydroxide used to prepare alkaline conditions may be in a completely aqueous solution or an aqueous solution comprising one or more water-soluble organic solvents such as ethanol or isopropanol. Alternatively, an alkali hydroxide can be added as a solid to provide alkaline conditions.

Various organic solvents that can optionally be included or used as the main solvent when preparing the etherification reaction include alcohols, acetone, dioxane, isopropanol and toluene, for example. Toluene or isopropanol can be used in certain embodiments. An organic solvent can be added before or after addition of alkali hydroxide. The concentration of an organic solvent (e.g., isopropanol or toluene) in a preparation comprising the present α-glucan oligomers/polymers and an alkali hydroxide can be at least about 10, 15, 20, 25, 30, 35, 40, 45, 50, 55, 60, 65, 70, 75, 80, 85, or 90 wt % (or any integer between 10 and 90 wt %).

Alternatively, solvents that can dissolve the present α-glucan oligomers/polymers can be used when preparing the etherification reaction. These solvents include, but are not limited to, lithium chloride (LiCl)/N,N-dimethyl-acetamide (DMAc), $SO_2$/diethylamine (DEA)/dimethyl sulfoxide (DMSO), LiCl/1,3-dimethyl-2-imidazolidinone (DMI), N,N-dimethylformamide (DMF)/$N_2O_4$, DMSO/tetrabutyl-ammonium fluoride trihydrate (TBAF), N-methylmorpholine-N-oxide (NMMO), $Ni(tren)(OH)_2$ [tren¼tris(2-aminoethyl)amine] aqueous solutions and melts of $LiClO_4·3H_2O$, NaOH/urea aqueous solutions, aqueous sodium hydroxide, aqueous potassium hydroxide, formic acid, and ionic liquids.

The present α-glucan oligomers/polymers can be contacted with a solvent and one or more alkali hydroxides by mixing. Such mixing can be performed during or after adding these components with each other. Mixing can be performed by manual mixing, mixing using an overhead mixer, using a magnetic stir bar, or shaking, for example. In certain embodiments, the present α-glucan oligomers/polymers can first be mixed in water or an aqueous solution before it is mixed with a solvent and/or alkali hydroxide.

After contacting the present α-glucan oligomers/polymers, solvent, and one or more alkali hydroxides with each other, the resulting composition can optionally be maintained at ambient temperature for up to 14 days. The term "ambient temperature" as used herein refers to a temperature between about 15-30° C. or 20-25° C. (or any integer between 15 and 30° C.). Alternatively, the composition can be heated with or without reflux at a temperature from about 30° C. to about 150° C. (or any integer between 30 and 150° C.) for up to about 48 hours. The composition in certain embodiments can be heated at about 55° C. for about 30 minutes or about 60 minutes. Thus, a composition obtained from mixing the present α-glucan oligomers/polymers, solvent, and one or more alkali hydroxides with each other can be heated at about 50, 51, 52, 53, 54, 55, 56, 57, 58, 59, or 60° C. for about 30-90 minutes.

After contacting the present α-glucan oligomers/polymers, solvent, and one or more alkali hydroxides with each other, the resulting composition can optionally be filtered (with or without applying a temperature treatment step). Such filtration can be performed using a funnel, centrifuge, press filter, or any other method and/or equipment known in the art that allows removal of liquids from solids. Though filtration would remove much of the alkali hydroxide, the filtered α-glucan oligomers/polymers would remain alkaline (i.e., mercerized α-glucan), thereby providing alkaline conditions.

An etherification agent comprising an organic group can be contacted with the present α-glucan oligomers/polymers in a reaction under alkaline conditions in a method herein of producing the respective α-glucan ether compounds. For example, an etherification agent can be added to a composition prepared by contacting the present α-glucan oligomers/polymers composition, solvent, and one or more alkali hydroxides with each other as described above. Alternatively, an etherification agent can be included when preparing the alkaline conditions (e.g., an etherification agent can be mixed with the present α-glucan oligomers/polymers and solvent before mixing with alkali hydroxide).

An etherification agent herein can refer to an agent that can be used to etherify one or more hydroxyl groups of glucose monomeric units of the present α-glucan oligomers/polymers with an organic group as disclosed herein. Examples of organic groups include alkyl groups, hydroxy alkyl groups, and carboxy alkyl groups. One or more etherification agents may be used in the reaction.

Etherification agents suitable for preparing an alkyl α-glucan ether compound include, for example, dialkyl sulfates, dialkyl carbonates, alkyl halides (e.g., alkyl chloride), iodoalkanes, alkyl triflates (alkyl trifluoromethanesulfonates) and alkyl fluorosulfonates. Thus, examples of etherification agents for producing methyl α-glucan ethers include dimethyl sulfate, dimethyl carbonate, methyl chloride, iodomethane, methyl triflate and methyl fluorosulfonate. Examples of etherification agents for producing ethyl α-glucan ethers include diethyl sulfate, diethyl carbonate, ethyl chloride, iodoethane, ethyl triflate and ethyl fluorosulfonate. Examples of etherification agents for producing propyl α-glucan ethers include dipropyl sulfate, dipropyl carbonate, propyl chloride, iodopropane, propyl triflate and propyl fluorosulfonate. Examples of etherification agents for producing butyl α-glucan ethers include dibutyl sulfate, dibutyl carbonate, butyl chloride, iodobutane and butyl triflate.

Etherification agents suitable for preparing a hydroxyalkyl α-glucan ether compound include, for example, alkylene oxides such as ethylene oxide, propylene oxide (e.g., 1,2-propylene oxide), butylene oxide (e.g., 1,2-butylene oxide; 2,3-butylene oxide; 1,4-butylene oxide), or combinations thereof. As examples, propylene oxide can be used as an etherification agent for preparing hydroxypropyl α-glucan, and ethylene oxide can be used as an etherification agent for preparing hydroxyethyl α-glucan. Alternatively, hydroxyalkyl halides (e.g., hydroxyalkyl chloride) can be used as etherification agents for preparing hydroxyalkyl α-glucan. Examples of hydroxyalkyl halides include hydroxyethyl halide, hydroxypropyl halide (e.g., 2-hydroxypropyl chloride, 3-hydroxypropyl chloride) and hydroxybutyl halide. Alternatively, alkylene chlorohydrins can be used as etherification agents for preparing hydroxyalkyl α-glucan ethers. Alkylene chlorohydrins that can be used include, but are not limited to, ethylene chlorohydrin, propylene chlorohydrin, butylene chlorohydrin, or combinations of these.

Etherification agents suitable for preparing a dihydroxyalkyl α-glucan ether compound include dihydroxyalkyl halides (e.g., dihydroxyalkyl chloride) such as dihydroxyethyl halide, dihydroxypropyl halide (e.g., 2,3-dihydroxypropyl chloride [i.e., 3-chloro-1,2-propanediol]), or dihydroxybutyl halide, for example. 2,3-dihydroxypropyl chloride can be used to prepare dihydroxypropyl α-glucan ethers, for example.

Etherification agents suitable for preparing a carboxyalkyl α-glucan ether compounds may include haloalkylates (e.g., chloroalkylate). Examples of haloalkylates include haloacetate (e.g., chloroacetate), 3-halopropionate (e.g., 3-chloropropionate) and 4-halobutyrate (e.g., 4-chlorobutyrate). For example, chloroacetate (monochloroacetate) (e.g., sodium chloroacetate) can be used as an etherification agent to prepare carboxymethyl α-glucan. An etherification agent herein can alternatively comprise a positively charged organic group.

An etherification agent in certain embodiments can etherify α-glucan oligomers/polymers with a positively charged organic group, where the carbon chain of the positively charged organic group only has a substitution with a positively charged group (e.g., substituted ammonium group such as trimethylammonium). Examples of such etherification agents include dialkyl sulfates, dialkyl carbonates, alkyl halides (e.g., alkyl chloride), iodoalkanes, alkyl triflates (alkyl trifluoromethanesulfonates) and alkyl fluorosulfonates, where the alkyl group(s) of each of these agents has one or more substitutions with a positively charged group (e.g., substituted ammonium group such as trimethylammonium). Other examples of such etherification agents include dimethyl sulfate, dimethyl carbonate, methyl chloride, iodomethane, methyl triflate and methyl fluorosulfonate, where the methyl group(s) of each of these agents has a substitution with a positively charged group (e.g., substituted ammonium group such as trimethylammonium). Other examples of such etherification agents include diethyl sulfate, diethyl carbonate, ethyl chloride, iodoethane, ethyl triflate and ethyl fluorosulfonate, where the ethyl group(s) of each of these agents has a substitution with a positively charged group (e.g., substituted ammonium group such as trimethylammonium). Other examples of such etherification agents include dipropyl sulfate, dipropyl carbonate, propyl chloride, iodopropane, propyl triflate and propyl fluorosulfonate, where the propyl group(s) of each of these agents has one or more substitutions with a positively charged group (e.g., substituted ammonium group such as trimethylammonium). Other examples of such etherification agents include dibutyl sulfate, dibutyl carbonate, butyl chloride, iodobutane and butyl triflate, where the butyl group(s) of each of these agents has one or more substitutions with a positively charged group (e.g., substituted ammonium group such as trimethylammonium).

An etherification agent alternatively may be one that can etherify the present α-glucan oligomers/polymers with a positively charged organic group, where the carbon chain of the positively charged organic group has a substitution (e.g., hydroxyl group) in addition to a substitution with a positively charged group (e.g., substituted ammonium group such as trimethylammonium). Examples of such etherification agents include hydroxyalkyl halides (e.g., hydroxyalkyl chloride) such as hydroxypropyl halide and hydroxybutyl halide, where a terminal carbon of each of these agents has a substitution with a positively charged group (e.g., substituted ammonium group such as trimethylammonium); an example is 3-chloro-2-hydroxypropyl-trimethylammonium. Other examples of such etherification agents include alkylene oxides such as propylene oxide (e.g., 1,2-propylene oxide) and butylene oxide (e.g., 1,2-butylene oxide; 2,3-butylene oxide), where a terminal carbon of each of these agents has a substitution with a positively charged group (e.g., substituted ammonium group such as trimethylammonium).

A substituted ammonium group comprised in any of the foregoing etherification agent examples can be a primary, secondary, tertiary, or quaternary ammonium group. Examples of secondary, tertiary and quaternary ammonium groups are represented in structure I, where $R_2$, $R_3$ and $R_4$ each independently represent a hydrogen atom or an alkyl group such as a methyl, ethyl, propyl, or butyl group. Etherification agents herein typically can be provided as a fluoride, chloride, bromide, or iodide salt (where each of the foregoing halides serve as an anion).

When producing the present α-glucan ether compounds with two or more different organic groups, two or more different etherification agents would be used, accordingly. For example, both an alkylene oxide and an alkyl chloride could be used as etherification agents to produce an alkyl hydroxyalkyl α-glucan ether. Any of the etherification agents disclosed herein may therefore be combined to produce α-glucan ether compounds with two or more different organic groups. Such two or more etherification agents may be used in the reaction at the same time, or may be used sequentially in the reaction. When used sequentially, any of the temperature-treatment (e.g., heating) steps disclosed below may optionally be used between each addition. One may choose sequential introduction of etherification agents in order to control the desired DoS of each organic group. In general, a particular etherification agent would be used first if the organic group it forms in the ether product is desired at a higher DoS compared to the DoS of another organic group to be added.

The amount of etherification agent to be contacted with the present α-glucan oligomers/polymers in a reaction under alkaline conditions can be determined based on the DoS required in the α-glucan ether compound being produced. The amount of ether substitution groups on each glucose monomeric unit in α-glucan ether compounds produced herein can be determined using nuclear magnetic resonance (NMR) spectroscopy. The molar substitution (MS) value for α-glucan has no upper limit. In general, an etherification agent can be used in a quantity of at least about 0.05 mole per mole of α-glucan. There is no upper limit to the quantity of etherification agent that can be used.

Reactions for producing α-glucan ether compounds herein can optionally be carried out in a pressure vessel such as a Parr reactor, an autoclave, a shaker tube or any other pressure vessel well known in the art. A reaction herein can optionally be heated following the step of contacting the present α-glucan oligomers/polymers with an etherification agent under alkaline conditions. The reaction temperatures and time of applying such temperatures can be varied within wide limits. For example, a reaction can optionally be maintained at ambient temperature for up to 14 days. Alternatively, a reaction can be heated, with or without reflux, between about 25° C. to about 200° C. (or any integer between 25 and 200° C.). Reaction time can be varied correspondingly: more time at a low temperature and less time at a high temperature.

In certain embodiments of producing carboxymethyl α-glucan ethers, a reaction can be heated to about 55° C. for about 3 hours. Thus, a reaction for preparing a carboxyalkyl α-glucan ether herein can be heated to about 50° C. to about 60° C. (or any integer between 50 and 60° C.) for about 2 hours to about 5 hours, for example. Etherification agents such as a haloacetate (e.g., monochloroacetate) may be used in these embodiments, for example.

Optionally, an etherification reaction herein can be maintained under an inert gas, with or without heating. As used herein, the term "inert gas" refers to a gas which does not undergo chemical reactions under a set of given conditions, such as those disclosed for preparing a reaction herein.

All of the components of the reactions disclosed herein can be mixed together at the same time and brought to the desired reaction temperature, whereupon the temperature is maintained with or without stirring until the desired α-glucan ether compound is formed. Alternatively, the mixed components can be left at ambient temperature as described above.

Following etherification, the pH of a reaction can be neutralized. Neutralization of a reaction can be performed using one or more acids. The term "neutral pH" as used herein, refers to a pH that is neither substantially acidic or basic (e.g., a pH of about 6-8, or about 6.0, 6.2, 6.4, 6.6, 6.8, 7.0, 7.2, 7.4, 7.6, 7.8, or 8.0). Various acids that can be used for this purpose include, but are not limited to, sulfuric, acetic (e.g., glacial acetic), hydrochloric, nitric, any mineral (inorganic) acid, any organic acid, or any combination of these acids.

The present α-glucan ether compounds produced in a reaction herein can optionally be washed one or more times with a liquid that does not readily dissolve the compound. For example, α-glucan ether can typically be washed with alcohol, acetone, aromatics, or any combination of these, depending on the solubility of the ether compound therein (where lack of solubility is desirable for washing). In general, a solvent comprising an organic solvent such as alcohol is preferred for washing an α-glucan ether. The present α-glucan ether product(s) can be washed one or more times with an aqueous solution containing methanol or ethanol, for example. For example, 70-95 wt % ethanol can be used to wash the product. The present α-glucan ether product can be washed with a methanol:acetone (e.g., 60:40) solution in another embodiment.

An α-glucan ether produced in the disclosed reaction can be isolated. This step can be performed before or after neutralization and/or washing steps using a funnel, centrifuge, press filter, or any other method or equipment known in the art that allows removal of liquids from solids. An isolated α-glucan ether product can be dried using any method known in the art, such as vacuum drying, air drying, or freeze drying.

Any of the above etherification reactions can be repeated using an α-glucan ether product as the starting material for further modification. This approach may be suitable for increasing the DoS of an organic group, and/or adding one or more different organic groups to the ether product.

The structure, molecular weight and DoS of the α-glucan ether product can be confirmed using various physiochemical analyses known in the art such as NMR spectroscopy and size exclusion chromatography (SEC).

Personal Care and/or Pharmaceutical Compositions Comprising the Present Soluble Oligomer/Polymer The present glucan oligomer/polymers and/or the present α-glucan ethers may be used in personal care products. For example, one may be able to use such materials as humectants, hydrocolloids or possibly thickening agents. The present α-glucan oligomers/polymers and/or the present α-glucan ethers may be used in conjunction with one or more other types of thickening agents if desired, such as those disclosed in U.S. Pat. No. 8,541,041, the disclosure of which is incorporated herein by reference in its entirety.

Personal care products herein are not particularly limited and include, for example, skin care compositions, cosmetic compositions, antifungal compositions, and antibacterial compositions. Personal care products herein may be in the form of, for example, lotions, creams, pastes, balms, ointments, pomades, gels, liquids, combinations of these and the like. The personal care products disclosed herein can include at least one active ingredient. An active ingredient is generally recognized as an ingredient that causes the intended pharmacological effect.

In certain embodiments, a skin care product can be applied to skin for addressing skin damage related to a lack of moisture. A skin care product may also be used to address the visual appearance of skin (e.g., reduce the appearance of flaky, cracked, and/or red skin) and/or the tactile feel of the skin (e.g., reduce roughness and/or dryness of the skin while improved the softness and subtleness of the skin). A skin care product typically may include at least one active ingredient for the treatment or prevention of skin ailments, providing a cosmetic effect, or for providing a moisturizing benefit to skin, such as zinc oxide, petrolatum, white petrolatum, mineral oil, cod liver oil, lanolin, dimethicone, hard fat, vitamin A, allantoin, calamine, kaolin, glycerin, or colloidal oatmeal, and combinations of these. A skin care product may include one or more natural moisturizing factors such as ceramides, hyaluronic acid, glycerin, squalane, amino acids, cholesterol, fatty acids, triglycerides, phospholipids, glycosphingolipids, urea, linoleic acid, glycosaminoglycans, mucopolysaccharide, sodium lactate, or sodium pyrrolidone carboxylate, for example. Other ingredients that may be included in a skin care product include, without limitation, glycerides, apricot kernel oil, canola oil, squalane, squalene, coconut oil, corn oil, jojoba oil, jojoba wax, lecithin, olive oil, safflower oil, sesame oil, shea butter, soybean oil, sweet almond oil, sunflower oil, tea tree oil, shea butter, palm oil, cholesterol, cholesterol esters, wax esters, fatty acids, and orange oil.

A personal care product herein can also be in the form of makeup or other product including, but not limited to, a lipstick, mascara, rouge, foundation, blush, eyeliner, lip liner, lip gloss, other cosmetics, sunscreen, sun block, nail polish, mousse, hair spray, styling gel, nail conditioner, bath gel, shower gel, body wash, face wash, shampoo, hair conditioner (leave-in or rinse-out), cream rinse, hair dye, hair coloring product, hair shine product, hair serum, hair anti-frizz product, hair split-end repair product, lip balm, skin conditioner, cold cream, moisturizer, body spray, soap, body scrub, exfoliant, astringent, scruffing lotion, depilatory, permanent waving solution, antidandruff formulation, anti-perspirant composition, deodorant, shaving product, pre-shaving product, after-shaving product, cleanser, skin gel, rinse, toothpaste, or mouthwash, for example.

A pharmaceutical product herein can be in the form of an emulsion, liquid, elixir, gel, suspension, solution, cream, capsule, tablet, sachet or ointment, for example. Also, a pharmaceutical product herein can be in the form of any of the personal care products disclosed herein. A pharmaceutical product can further comprise one or more pharmaceutically acceptable carriers, diluents, and/or pharmaceutically acceptable salts. The present α-glucan oligomers/polymers and/or compositions comprising the present α-glucan oligomers/polymers can also be used in capsules, encapsulants, tablet coatings, and as an excipients for medicaments and drugs.

Enzymatic Synthesis of the Soluble α-Glucan Oligomers/Polymer Composition

Methods are provided to enzymatically produce a soluble α-glucan oligomer/polymer composition. In one embodiment, the method comprises the use of at least one recombinantly produced glucosyltransferase belong to glucoside hydrolase type 70 (E.C. 2.4.1.-) capable of catalyzing the synthesis of a digestion resistant soluble α-glucan oligomer/polymer composition using sucrose as a substrate. Glycoside hydrolase family 70 enzymes are transglucosidases produced by lactic acid bacteria such as *Streptococcus, Leuconostoc, Weisella* or *Lactobacillus* genera (see Carbohydrate Active Enzymes database; "CAZy"; Cantarel et al., (2009) *Nucleic Acids Res* 37:D233-238). The recombinantly expressed glucosyltransferases preferably have an amino acid sequence identical to that found in nature (i.e., the same as the full length sequence as found in the source organism or a catalytically active truncation thereof).

GTF enzymes are able to polymerize the D-glucosyl units of sucrose to form homooligosaccharides or homopolysaccharides. Depending upon the specificity of the GTF enzyme, linear and/or branched glucans comprising various glycosidic linkages may be formed such as α-(1,2), α-(1,3), α-(1,4) and α-(1,6). Glucosyltransferases may also transfer the D-glucosyl units onto hydroxyl acceptor groups. A non-limiting list of acceptors may include carbohydrates, alcohols, polyols or flavonoids. The structure of the resultant glucosylated product is dependent upon the enzyme specificity.

In the present disclosure the D-glucopyranosyl donor is sucrose. As such the reaction is:

$$\text{Sucrose+GTF} \leftrightarrows \alpha\text{-D-(Glucose)}_n\text{+D-Fructose+GTF}$$

The type of glycosidic linkage predominantly formed is used to name/classify the glucosyltransferase enzyme. Examples include dextransucrases (α-(1,6) linkages; EC 2.4.1.5), mutansucrases (α-(1,3) linkages; EC 2.4.1.-), alternansucrases (alternating a(1,3)-α(1,6) backbone; EC 2.4.1.140), and reuteransucrases (mix of α-(1,4) and α-(1,6) linkages; EC 2.4.1.-).

In one aspect, the glucosyltransferase (GTF) is capable of forming glucans having 50% or more α-(1,3) glycosidic linkages with the proviso that that glucan product is not alternan (i.e., the enzyme is not an alternansucrase). In a preferred aspect, the glucosyltransferase is a mutansucrase (EC 2.4.1.-). As described above, amino acid residues which influence mutansucrase function have previously been characterized. See, A. Shimamura et al. (*J. Bacteriology*, (1994) 176:4845-4850).

The glucosyltransferase is preferably a glucosyltransferase capable of producing a glucan with at least 75% α-(1,3) glycosidic linkages. In certain embodiments, the glucosyltransferase comprises an amino acid sequence having at least 90% sequence identity, including at least 95%, at least 96%, at least 97%, at least 98%, at least 99%, or which is identical to SEQ ID NO: 153. In certain embodiments, the glucosyltransferase comprising an amino acid sequence with 90% or greater sequence identity to SEQ ID NO: 153 is GTF-S, a homolog thereof, a truncation thereof, or a truncation of a homolog thereof. In certain embodiments, the glucosyltransferase comprises an amino acid sequence selected from the group consisting of SEQ ID NOs: 3, 5, 17, 19, 88, 90, 92, 94, 96, 98, 100, 102, 104, 106, 108, 110, 112, and any combination thereof. However, it should be noted that some wild type sequences may be found in nature in a truncated form. As such, and in a further embodiment, the glucosyltransferase suitable for use may be a truncated form of the wild type sequence. In a further embodiment, the truncated glucosyltransferase comprises a sequence derived from the full length wild type amino acid sequence selected from the group consisting of SEQ ID NOs: 3 and 17. In another embodiment, the glucosyltransferase may be truncated and will have an amino acid sequence selected from the group consisting of SEQ ID NOs: 5 and 19. In another embodiment, the glucosyltransferase comprises SEQ ID NO: 5. In yet another embodiment, the glucosyltransferase is truncated and is derived from SEQ ID NO: 19. In certain other embodiments, the truncated glucosyltransferase comprises an amino acid sequence selected from the group consisting of SEQ ID NOs: 118, 120, 122, 124, 126, 128, 130, 132, 134, 136, 138, 140, 142, 144, 146, 148, 150, and 152. The concentration of the catalyst in the aqueous reaction formulation depends on the specific catalytic activity of the catalyst, and is chosen to obtain the desired rate of reaction. The weight of each catalyst (either a single glucosyltransferase or individually a glucosyltransferase and α-glucanohydrolase) reactions typically ranges from 0.0001 mg to 20 mg per mL of total reaction volume, preferably from 0.001 mg to 10 mg per mL. The catalyst may also be immobilized on a soluble or insoluble support using methods well-known to those skilled in the art; see for example, *Immobilization of Enzymes and Cells*; Gordon F. Bickerstaff, Editor; Humana Press, Totowa, NJ, USA; 1997. The use of immobilized catalysts permits the recovery and reuse of the catalyst in subsequent reactions. The enzyme catalyst may be in the form of whole microbial cells, permeabilized microbial cells, microbial cell extracts, partially-purified or purified enzymes, and mixtures thereof.

The pH of the final reaction formulation is from about 3 to about 8, preferably from about 4 to about 8, more preferably from about 5 to about 8, even more preferably about 5.5 to about 7.5, and yet even more preferably about 5.5 to about 6.5. The pH of the reaction may optionally be controlled by the addition of a suitable buffer including, but not limited to, phosphate, pyrophosphate, bicarbonate, acetate, or citrate. The concentration of buffer, when employed, is typically from 0.1 mM to 1.0 M, preferably from 1 mM to 300 mM, most preferably from 10 mM to 100 mM.

The sucrose concentration initially present when the reaction components are combined is at least 50 g/L, preferably 50 g/L to 600 g/L, more preferably 100 g/L to 500 g/L, more preferably 150 g/L to 450 g/L, and most preferably 250 g/L to 450 g/L. The substrate for the α-glucanohydrolase (when present) will be the members of the glucose oligomer population formed by the glucosyltransferase. As the glucose oligomers present in the reaction system may act as acceptors, the exact concentration of each species present in the reaction system will vary. Additionally, other acceptors may be added (i.e., external acceptors) to the initial reaction mixture such as maltose, isomaltose, isomaltotriose, and methyl-α-D-glucan, to name a few.

The length of the reaction may vary and may often be determined by the amount of time it takes to use all of the available sucrose substrate. In one embodiment, the reaction is conducted until at least 90%, preferably at least 95% and most preferably at least 99% of the sucrose initially present in the reaction mixture is consumed. In another embodiment, the reaction time is 1 hour to 168 hours, preferably 1 hour to 72 hours, and most preferably 1 hour to 24 hours.

Single Enzyme Method (Glucosyltransferase) Using Elevated Reaction Temperature

The optimum temperature for many GH70 family glucosyltransferases is often between 25° C. and 35° C. with rapid inactivation often observed at temperatures exceeding 55° C. — 60° C. However, it has been discovered that certain glucosyltransferases may be capable of producing the desired soluble glucan oligomer/polymer composition from sucrose when the reaction is conducted at elevated temperatures (defined herein as a temperature of at least 45° C. yet below the inactivation temperature of the enzyme).

In one aspect, the glucosyltransferase is capable of producing the present glucan oligomer/polymer from sucrose when the reaction is conducted at a temperature of at least 45° C., but below the temperature where the enzyme is thermally inactivated. In a further aspect, the temperature for running the glucosyltransferase reaction is conducted at a temperature of at least 47° C. but less than the inactivation temperature of the specified enzyme. In one aspect, the upper limit of the reaction temperature is equal to or less than 55° C. In another embodiment, the reaction temperature is 47° C. to 52° C. In a further aspect, the glucosyltransferase used in the single enzyme method comprises an amino acid sequence derived from a polypeptide having an amino acid sequence selected from the group consisting of SEQ ID NO: 3 and 5. In a preferred aspect, the glucosyltransferase is derived from the *Streptococcus salivarius* GtfJ glucosyltransferase (GENBANK® gi: 47527; SEQ ID NO: 3). In a further preferred embodiment, the glucosyltransferase is SEQ ID NO: 3 or a catalytically active truncation retaining the glucosyltransferase activity thereof.

Soluble Glucan Oligomer/Polymer Synthesis—Reaction Systems Comprising a Glucosyltransferase (Gtf) and an α-Glucanohydrolase A method is provided to enzymatically produce the present soluble glucan oligomers/polymers using at least one α-glucanohydrolase in combination (i.e., concomitantly in the reaction mixture) with at least one of the above glucosyltransferases. The simultaneous use of the two enzymes produces a different product profile (i.e., the profile of the soluble oligomer/polymer composition) when compared to a sequential application of the same enzymes (i.e., first synthesizing the glucan polymer from sucrose using a glucosyltransferase and then subsequently treating the glucan polymer with an α-glucanohydrolase). In one embodiment, a glucan oligomer/polymer synthesis method based on sequential application of a glucosyltransferase with an α-glucanohydrolase is specifically excluded.

Similar to the glucosyltransferases, an α-glucanohydrolase may be defined by the endohydrolysis activity towards certain α-D-glycosidic linkages. Examples may include, but are not limited to, dextranases (capable of hydrolyzing α-(1,6)-linked glycosidic bonds; E.C. 3.2.1.11), mutanases (capable of hydrolyzing α-(1,3)-linked glycosidic bonds; E.C. 3.2.1.59), mycodextranases (capable of endohydrolysis of (1→4)-α-D-glucosidic linkages in α-D-glucans containing both (1→3)- and (1→4)-bonds; EC 3.2.1.61), glucan 1,6-α-glucosidase (EC 3.2.1.70), and alternanases (capable of endohydrolytically cleaving alternan; E.C. 3.2.1.-; see U.S. Pat. No. 5,786,196). Various factors including, but not limited to, level of branching, the type of branching, and the relative branch length within certain α-glucans may adversely impact the ability of an α-glucanohydrolase to endohydrolyze some glycosidic linkages.

In one embodiment, the α-glucanohydrolase is a dextranase (EC 3.2.1.11), a mutanase (EC 3.1.1.59) or a combination thereof. In one embodiment, the dextranase is a food grade dextranase from *Chaetomium erraticum*. In a further embodiment, the dextranase from *Chaetomium erraticum* is DEXTRANASE® PLUS L, available from Novozymes A/S, Denmark.

In another embodiment, the α-glucanohydrolase is at least one mutanase (EC 3.1.1.59). Mutanases useful in the methods disclosed herein can be identified by their characteristic structure. See, e.g., Y. Hakamada et al. (*Biochimie*, (2008) 90:525-533). In one embodiment, the mutanase is one obtainable from the genera *Penicillium, Paenibacillus, Hypocrea, Aspergillus*, and *Trichoderma*. In a further embodiment, the mutanase is from *Penicillium marneffei* ATCC 18224 or *Paenibacillus humicus*. In one embodiment, the mutanase comprises an amino acid sequence selected from SEQ ID NOs 21, 22, 24, 27, 29, 54, 56, 58, and any combination thereof. In yet a further embodiment, the mutanase comprises an amino acid sequence selected from SEQ ID NO: 21, 22, 24, 27 and any combination thereof. In another embodiment, the above mutanases may be a catalytically active truncation so long as the mutanase activity is retained. The temperature of the enzymatic reaction system comprising concomitant use of at least one glucosyltransferase and at least one α-glucanohydrolase may be chosen to control both the reaction rate and the stability of the enzyme catalyst activity. The temperature of the reaction may range from just above the freezing point of the reaction formulation (approximately 0° C.) to about 60° C., with a preferred range of 5° C. to about 55° C., and a more preferred range of reaction temperature of from about 20° C. to about 47° C.

The ratio of glucosyltransferase to α-glucanohydrolase (v/v) may vary depending upon the selected enzymes. In one embodiment, the ratio of glucosyltransferase to α-glucanohydrolase (v/v) ranges from 1:0.01 to 0.01:1.0. In another embodiment, the ratio of glucosyltransferase to α-glucanohydrolase (units of activity/units of activity) may vary depending upon the selected enzymes. In still further embodiments, the ratio of glucosyltransferase to α-glucanohydrolase (units of activity/units of activity) ranges from 1:0.01 to 0.01:1.0. In one embodiment, a method is provided to produce a soluble α-glucan oligomer/polymer composition comprising:

1. providing a set of reaction components comprising:
   a. sucrose;
   b. at least one glucosyltransferase capable of catalyzing the synthesis of glucan polymers having at least 75% α-(1,3) glycosidic linkages;
   c. at least one α-glucanohydrolase capable of hydrolyzing glucan polymers having one or more α-(1,3) glycosidic linkages or one or more α-(1,6) glycosidic linkages; and
   d. optionally one more acceptors; and
2. combining the set of reaction components under suitable aqueous reaction conditions whereby a soluble α-glucan oligomer/polymer composition is produced.

In a preferred embodiment, the at least one glucosyltransferase and the at least one α-glucanohydrolase are concomitantly present in the reaction to produce the soluble α-glucan oligomer/polymer composition.

In one embodiment, the least one glucosyltransferase capable of catalyzing the synthesis of glucan polymers having one or more α-(1,3) glycosidic linkages is a mutansucrase.

In another embodiment, the at least one α-glucanohydrolase capable of hydrolyzing glucan polymers having one or more α-(1,3) glycosidic linkages or one or more α-(1,6) glycosidic linkages is an endomutanase.

In a preferred embodiment, the set of reaction components comprises the concomitant use of a mutansucrase and a mutanase.

The method to produce a soluble α-glucan oligomer/polymer may further comprise one or more additional steps to obtain the soluble α-glucan oligomer/polymer composition. As such, and in a further embodiment, a method is provided comprising:

1) providing a set of reaction components comprising:
   i) sucrose;
   ii) at least one glucosyltransferase capable of catalyzing the synthesis of glucan polymers having at least 75% α-(1,3) glycosidic linkages;
   iii) at least one α-glucanohydrolase capable of hydrolyzing glucan polymers having one or more α-(1,3) glycosidic linkages or one or more α-(1,6) glycosidic linkages; and
   iv) optionally one more acceptors;
2. combining the set of reaction components under suitable aqueous reaction conditions whereby a product mixture comprising a soluble α-glucan oligomer/polymer composition is produced;
3. isolating the soluble α-glucan oligomer/polymer composition from the product mixture of step 2; and
4. optionally concentrating the soluble α-glucan oligomer/polymer composition.

Methods to Identify Substantially Similar Enzymes Having the Desired Activity

The skilled artisan recognizes that substantially similar enzyme sequences may also be used in the present compositions and methods so long as the desired activity is retained (i.e., glucosyltransferase activity capable of forming glucans having the desired glycosidic linkages or α-glucanohydrolases having endohydrolytic activity towards the target glycosidic linkage(s)). For example, it has been demonstrated that catalytically activity truncations may be prepared and used so long as the desired activity is retained (or even improved in terms of specific activity). In one embodiment, substantially similar sequences are defined by their ability to hybridize, under highly stringent conditions with the nucleic acid molecules associated with sequences exemplified herein. In another embodiment, sequence alignment algorithms may be used to define substantially similar enzymes based on the percent identity to the DNA or amino acid sequences provided herein.

As used herein, a nucleic acid molecule is "hybridizable" to another nucleic acid molecule, such as a cDNA, genomic DNA, or RNA, when a single strand of the first molecule can anneal to the other molecule under appropriate conditions of temperature and solution ionic strength. Hybridization and washing conditions are well known and exemplified in Sambrook, J. and Russell, D., T. *Molecular Cloning: A Laboratory Manual*, Third Edition, Cold Spring Harbor Laboratory Press, Cold Spring Harbor (2001). The conditions of temperature and ionic strength determine the "stringency" of the hybridization. Stringency conditions can be adjusted to screen for moderately similar molecules, such as homologous sequences from distantly related organisms, to highly similar molecules, such as genes that duplicate functional enzymes from closely related organisms. Post-hybridization washes typically determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of conditions uses higher temperatures in which the washes are identical to those above except for the temperature of the final two 30 min washes in 0.2×SSC, 0.5% SDS was increased to 60° C. Another preferred set of highly stringent hybridization conditions is 0.1×SSC, 0.1% SDS, 65° C. and washed with 2×SSC, 0.1% SDS followed by a final wash of 0.1×SSC, 0.1% SDS, 65° C.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (Sambrook, J. and Russell, D., T., supra). For hybridizations with shorter nucleic acids, i.e., oligonucleotides, the position of mismatches becomes more important, and the length of the oligonucleotide determines its specificity. In one aspect, the length for a hybridizable nucleic acid is at least about 10 nucleotides. Preferably, a minimum length for a hybridizable nucleic acid is at least about 15 nucleotides in length, more preferably at least about 20 nucleotides in length, even more preferably at least 30 nucleotides in length, even more preferably at least 300 nucleotides in length, and most preferably at least 800 nucleotides in length. Furthermore, the skilled artisan will recognize that the temperature and wash solution salt concentration may be adjusted as necessary according to factors such as length of the probe.

As used herein, the term "percent identity" is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: *Computational Molecular Biology* (Lesk, A. M., ed.) Oxford University Press, NY (1988); *Biocomputing: Informatics and Genome Projects* (Smith, D. W., ed.) Academic Press, NY (1993); *Computer Analysis of Sequence Data, Part I* (Griffin, A. M., and Griffin, H. G., eds.) Humana Press, NJ (1994); *Sequence Analysis in Molecular Biology* (von Heinje, G., ed.) Academic Press (1987); and *Sequence Analysis Primer* (Gribskov, M. and Devereux, J., eds.) Stockton Press, NY (1991). Methods to determine identity and similarity are codified in publicly available computer programs. Sequence alignments and percent identity calculations may be performed using the Megalign program of the LASERGENE bioinformatics computing suite (DNASTAR Inc., Madison, WI), the AlignX program of Vector NTI v. 7.0 (Informax, Inc., Bethesda, MD), or the EMBOSS Open Software Suite (EMBL-EBI; Rice et al., *Trends in Genetics* 16, (6):276-277 (2000)). Multiple alignment of the sequences can be performed using the CLUSTAL method (such as CLUSTALW; for example version 1.83) of alignment (Higgins and Sharp, *CABIOS,* 5:151-153 (1989); Higgins et al., *Nucleic Acids Res.* 22:4673-4680 (1994); and Chenna et al., *Nucleic Acids Res* 31 (13):3497-500 (2003)), available from the European Molecular Biology Laboratory via the European Bioinformatics Institute) with the default parameters. Suitable parameters for CLUSTALW protein alignments include GAP Existence penalty=15, GAP extension=0.2, matrix=Gonnet (e.g., Gonnet250), protein ENDGAP=−1, protein GAPDIST=4, and KTUPLE=1. In one embodiment, a fast or slow alignment is used with the default settings where a slow alignment is preferred. Alternatively, the parameters using the CLUSTALW method (e.g., version 1.83) may be modified to also use KTUPLE=1, GAP PENALTY=10, GAP extension=1, matrix=BLOSUM (e.g., BLOSUM64), WINDOW=5, and TOP DIAGONALS SAVED=5.

In one aspect, suitable isolated nucleic acid molecules encode a polypeptide having an amino acid sequence that is at least about 20%, preferably at least 30%, 40%, 50%, 60%, 70%, 80%, 85%, 90%, 91%, 92%, 93%, 94%, 95%, 96%, 97%, 98%, or 99% identical to the amino acid sequences reported herein. In another aspect, suitable isolated nucleic acid molecules encode a polypeptide having an amino acid sequence that is at least about 20%, preferably at least 30%, 40%, 50%, 60%, 70%, 80%, 85%, 90%, 91%, 92%, 93%, 94%, 95%, 96%, 97%, 98%, or 99% identical to the amino acid sequences reported herein; with the proviso that the polypeptide retains the respective activity (i.e., glucosyltransferase or α-glucanohydrolase activity). In certain embodiments, glucosyltransferases which retain the activity include those glucosyltransferases which comprise an amino acid sequence which is at least 90% identical to SEQ ID NO: 153.

Methods to Obtain the Enzymatically-Produced Soluble α-Glucan Oligomer/Polymer Composition Any number of common purification techniques may be used to obtain the present soluble α-glucan oligomer/polymer composition from the reaction system including, but not limited to centrifugation, filtration, fractionation, chromatographic separation, dialysis, evaporation, precipitation, dilution or any combination thereof, preferably by dialysis or chromatographic separation, most preferably by dialysis (ultrafiltration).

Recombinant Microbial Expression

The genes and gene products of the instant sequences may be produced in heterologous host cells, particularly in the cells of microbial hosts. Preferred heterologous host cells for expression of the instant genes and nucleic acid molecules are microbial hosts that can be found within the fungal or bacterial families and which grow over a wide range of temperature, pH values, and solvent tolerances. For example, it is contemplated that any of bacteria, yeast, and filamentous fungi may suitably host the expression of the present nucleic acid molecules. The enzyme(s) may be expressed intracellularly, extracellularly, or a combination of both intracellularly and extracellularly, where extracellular expression renders recovery of the desired protein from a fermentation product more facile than methods for recovery of protein produced by intracellular expression. Transcription, translation and the protein biosynthetic apparatus remain invariant relative to the cellular feedstock used to generate cellular biomass; functional genes will be expressed regardless. Examples of host strains include, but are not limited to, bacterial, fungal or yeast species such as *Aspergillus, Trichoderma, Saccharomyces, Pichia, Phaffia, Kluyveromyces, Candida, Hansenula, Yarrowia, Salmonella, Bacillus, Acinetobacter, Zymomonas, Agrobacterium, Erythrobacter, Chlorobium, Chromatium, Flavobacterium, Cytophaga, Rhodobacter, Rhodococcus, Streptomyces, Brevibacterium, Corynebacteria, Mycobacterium, Deinococcus, Escherichia, Erwinia, Pantoea, Pseudomonas, Sphingomonas, Methylomonas, Methylobacter, Methylococcus, Methylosinus, Methylomicrobium, Methylocystis, Alcaligenes, Synechocystis, Synechococcus, Anabaena, Thiobacillus, Methanobacterium, Klebsiella*, and *Myxococcus*. In one embodiment, the fungal host cell is *Trichoderma*, preferably a strain of *Trichoderma reesei*. In one embodiment, bacterial host strains include *Escherichia, Bacillus, Kluyveromyces*, and *Pseudomonas*. In a preferred embodiment, the bacterial host cell is *Bacillus subtilis* or *Escherichia coli.*

Large-scale microbial growth and functional gene expression may use a wide range of simple or complex carbohydrates, organic acids and alcohols or saturated hydrocarbons, such as methane or carbon dioxide in the case of photosynthetic or chemoautotrophic hosts, the form and amount of nitrogen, phosphorous, sulfur, oxygen, carbon or any trace micronutrient including small inorganic ions. The regulation of growth rate may be affected by the addition, or not, of specific regulatory molecules to the culture and which are not typically considered nutrient or energy sources.

Vectors or cassettes useful for the transformation of suitable host cells are well known in the art. Typically, the vector or cassette contains sequences directing transcription and translation of the relevant gene, a selectable marker, and sequences allowing autonomous replication or chromosomal integration. Suitable vectors comprise a region 5' of the gene which harbors transcriptional initiation controls and a region 3' of the DNA fragment which controls transcriptional termination. It is most preferred when both control regions are derived from genes homologous to the transformed host cell and/or native to the production host, although such control regions need not be so derived.

Initiation control regions or promoters which are useful to drive expression of the present cephalosporin C deacetylase coding region in the desired host cell are numerous and familiar to those skilled in the art. Virtually any promoter capable of driving these genes is suitable for the present disclosure including but not limited to, CYC1, HIS3, GAL1, GAL10, ADH1, PGK, PHO5, GAPDH, ADC1, TRP1, URA3, LEU2, ENO, TPI (useful for expression in *Saccharomyces*); AOX1 (useful for expression in *Pichia*); and lac, araB, tet, trp, $IP_L$, $IP_R$, T7, tac, and trc (useful for expression in *Escherichia coli*) as well as the amy, apr, npr promoters and various phage promoters useful for expression in *Bacillus*.

Termination control regions may also be derived from various genes native to the preferred host cell. In one embodiment, the inclusion of a termination control region is optional. In another embodiment, the chimeric gene includes a termination control region derived from the preferred host cell.

Industrial Production

A variety of culture methodologies may be applied to produce the enzyme(s). For example, large-scale production of a specific gene product over-expressed from a recombinant microbial host may be produced by batch, fed-batch, and continuous culture methodologies.

Batch and fed-batch culturing methods are common and well known in the art and examples may be found in *Biotechnology: A Textbook of Industrial Microbiology* by Wulf Crueger and Anneliese Crueger (authors), Second Edition, (Sinauer Associates, Inc., Sunderland, MA (1990) and *Manual of Industrial Microbiology and Biotechnology*, Third Edition, Richard H. Baltz, Arnold L. Demain, and Julian E. Davis (Editors), (ASM Press, Washington, DC (2010).

Commercial production of the desired enzyme(s) may also be accomplished with a continuous culture. Continuous cultures are an open system where a defined culture media is added continuously to a bioreactor and an equal amount of conditioned media is removed simultaneously for processing. Continuous cultures generally maintain the cells at a constant high liquid phase density where cells are primarily in log phase growth. Alternatively, continuous culture may be practiced with immobilized cells where carbon and nutrients are continuously added and valuable products, by-products or waste products are continuously removed from the cell mass. Cell immobilization may be performed using a wide range of solid supports composed of natural and/or synthetic materials.

Recovery of the desired enzyme(s) from a batch fermentation, fed-batch fermentation, or continuous culture, may be accomplished by any of the methods that are known to those skilled in the art. For example, when the enzyme catalyst is produced intracellularly, the cell paste is separated from the culture medium by centrifugation or membrane filtration, optionally washed with water or an aqueous buffer at a desired pH, then a suspension of the cell paste in an aqueous buffer at a desired pH is homogenized to produce a cell extract containing the desired enzyme catalyst. The cell extract may optionally be filtered through an appropriate filter aid such as celite or silica to remove cell debris prior to a heat-treatment step to precipitate undesired protein from the enzyme catalyst solution. The solution containing the desired enzyme catalyst may then be separated from the precipitated cell debris and protein by membrane filtration or centrifugation, and the resulting partially-purified enzyme catalyst solution concentrated by additional membrane filtration, then optionally mixed with an appropriate carrier (for example, maltodextrin, phosphate buffer, citrate buffer, or mixtures thereof) and spray-dried to produce a solid powder comprising the desired enzyme catalyst. Alternatively, the resulting partially-purified enzyme catalyst solution can be stabilized as a liquid formulation by the addition of polyols such as maltodextrin, sorbitol, or propylene glycol, to which is optionally added a preservative such as sorbic acid, sodium sorbate or sodium benzoate.

When an amount, concentration, or other value or parameter is given either as a range, preferred range, or a list of upper preferable values and lower preferable values, this is to be understood as specifically disclosing all ranges formed from any pair of any upper range limit or preferred value and any lower range limit or preferred value, regardless of whether ranges are separately disclosed. Where a range of numerical values is recited herein, unless otherwise stated, the range is intended to include the endpoints thereof, and all integers and fractions within the range. It is not intended that the scope be limited to the specific values recited when defining a range.

DESCRIPTION OF CERTAIN EMBODIMENTS

In a first embodiment (the "first embodiment"), a soluble α-glucan oligomer/polymer composition is provided, said soluble α-glucan oligomer/polymer composition comprising:

a. at least 75% α-(1,3) glycosidic linkages, preferably at least 80%, more preferably at least 85%, even more preferably at least 90%, and most preferably at least 95% α-(1,3) glycosidic linkages;

b. less than 25% α-(1,6) glycosidic linkages; preferably less than 10%, more preferably 5% or less, and even more preferably less than 1% α-(1,6) glycosidic linkages;

c. less than 10% α-(1,3,6) glycosidic linkages; preferably less than 5%, and most preferably less than 2.5% α-(1,3,6) glycosidic linkages;

d. a weight average molecular weight of less than 5000 Daltons; preferably less than 2500 Daltons, more preferably between 500 and 2500 Daltons, and most preferably about 500 to about 2000 Daltons;

e. a viscosity of less than 0.25 Pascal second (Pa·s), preferably less than 0.01 Pascal second (Pa·s), preferably less than 7 cP (0.007 Pa·s), more preferably less than 5 cP (0.005 Pa·s), more preferably less than 4 cP (0.004 Pa·s), and most preferably less than 3 cP (0.003 Pa·s) at 12 wt % in water at 20° C.

f. a solubility of at least 20% (w/w), preferably at least 30%, 40%, 50%, 60%, or 70%, in water at 25° C.; and g. a polydispersity index of less than 5.

In second embodiment, a fabric care, laundry care, or aqueous composition is provided comprising 0.01 to 99 wt % (dry solids basis), preferably 10 to 90% wt %, of the soluble α-glucan oligomer/polymer composition described above.

In another embodiment, a method is provided to produce a soluble α-glucan oligomer/polymer composition comprising:

a. providing a set of reaction components comprising:
   i. sucrose;
   ii. at least one glucosyltransferase capable of catalyzing the synthesis of glucan polymers having at least 75%, preferably at least 80%, more preferably at least 85%, even more preferably at least 90%, and most preferably at least 95% α-(1,3) glycosidic linkages;
   iii. at least one α-glucanohydrolase capable of hydrolyzing glucan polymers having one or more α-(1,3) glycosidic linkages or one or more α-(1,6) glycosidic linkages; and
   iv. optionally one more acceptors;

b. combining under suitable aqueous reaction conditions whereby a product comprising a soluble α-glucan oligomer/polymer composition is produced; and c. optionally isolating the soluble α-glucan oligomer/polymer composition from the product of step (b); and d. optionally concentrating the isolated soluble α-glucan oligomer/polymer composition of step (c).

In another embodiment, a method is provided to produce the α-glucan oligomer/polymer composition of the first embodiment comprising:

1. providing a set of reaction components comprising:
   1. sucrose;
   2. at least one glucosyltransferase capable of catalyzing the synthesis of glucan polymers having at least 75%, preferably at least 80%, more preferably at least 85%, even more preferably at least 90%, and most preferably at least 95% α-(1,3) glycosidic linkages;
   3. at least one α-glucanohydrolase capable of hydrolyzing glucan polymers having one or more α-(1,3) glycosidic linkages or one or more α-(1,6) glycosidic linkages; and
   4. optionally one more acceptors;
2. combining under suitable aqueous reaction conditions the set of reaction components of (a) to form a single reaction mixture, whereby a product mixture comprising glucose oligomers is formed;
3. isolating the soluble α-glucan oligomer/polymer composition of the first embodiment from the product mixture comprising glucose oligomers; and
4. optionally concentrating the soluble α-glucan oligomer/polymer composition.

A composition or method according to any of the above embodiments wherein the soluble α-glucan oligomer/polymer composition comprises less than 5%, preferably less than 1%, and most preferably less than 0.5% α-(1,4) glycosidic linkages.

A composition or method according to any of the above embodiments wherein the α-glucanohydrolase is an endomutanase and the glucosyltransferase is a mutansucrase.

A composition comprising 0.01 to 99 wt % (dry solids basis) of the present soluble α-glucan oligomer/polymer composition and at least one of the following ingredients: at least one cellulase, at least one protease or a combination thereof.

A method according to any of the above embodiments wherein the isolating step comprises at least one of centrifugation, filtration, fractionation, chromatographic separation, dialysis, evaporation, dilution or any combination thereof.

A method according to any of the above embodiments wherein the sucrose concentration in the single reaction mixture is initially at least 200 g/L upon combining the set of reaction components.

A method according to any of the above embodiments wherein the ratio of glucosyltransferase activity to α-glucanohydrolase activity ranges from 0.01:1 to 1:0.01.

A method according to any of the above embodiments wherein the suitable reaction conditions (for enzymatic glucan synthesis) comprises a reaction temperature between 0° C. and 45° C.

A method according to any of the above embodiments wherein the suitable reaction conditions comprise a pH range of 4 to 8.

A method according to any of the above embodiments wherein a buffer is present and is selected from the group consisting of phosphate, pyrophosphate, bicarbonate, acetate, or citrate Also provided are methods according to any of the embodiments wherein said at least one glucosyltransferase comprises an amino acid sequence is SEQ ID NOs: 3, 5, 17, 19, 88, 90, 92, 94, 96, 98, 100, 102, 104, 106, 108, 110, 112, or a combination thereof. In other embodiments, the at least one glucosyl transferase is GTF-S, a truncation thereof, a homolog thereof, or a truncation of a homolog thereof. In another embodiment, the glucosyltransferase is a truncation of GTF-S and comprises the amino acid sequence of SEQ ID NO: 126. In other embodiments, the glucosyl transferase is a truncation of a homolog of GTF-S and comprises an amino acid sequence is SEQ ID NO: 118, 120, 122, 124, 128, 130, 132, 134, 136, 138, 140, 142, 144, 146, 146, 148, 150, 152 or a combination thereof. A method according to any of the above embodiments wherein said at least one α-glucanohydrolase is selected from the group consisting of SEQ ID NOs 21, 22, 24, 27, 54, 56, 58, and any combination thereof.

A method according to any of the above embodiments wherein said at least one glucosyltransferase and said at least one α-glucanohydrolase is selected from the combinations of:

1. glucosyltransferase GTF7527 (SEQ ID NO: 3, 5 or a combination thereof) and mutanase MUT3325 (SEQ ID NO: 27)
2. glucosyltransferase GTF7527 (SEQ ID NO: 3, 5 or a combination thereof) and mutanase MUT3264 (SEQ ID NO: 21, 22, 24 or any combination thereof);
3. glucosyltransferase GTF0459 (SEQ ID NO: 17, 19 or a combination thereof) and mutanase MUT3325 (SEQ ID NO: 27); and
4. glucosyltransferase GTF0459 (SEQ ID NO: 17, 19 or a combination thereof) and mutanase MUT3264 (SEQ ID NO: 21, 22, 24 or any combination thereof).

In another embodiment, a method to produce the soluble α-glucan oligomer/polymer composition of the first embodiment is provided comprising:

a. providing a set of reaction components comprising:
   i. sucrose;
   ii. at least one glucosyltransferase capable of catalyzing the synthesis of glucan polymers having one or more α-(1,3) glycosidic linkages;
   iii. optionally one more acceptors;
b. combining under suitable aqueous reaction conditions the set of reaction components of (a) to form a single reaction mixture, wherein the reaction conditions comprises a reaction temperature greater than 45° C. and less than 55° C., preferably 47° C. to 53° C., whereby a product mixture comprising glucose oligomers is formed;
c. isolating the soluble α-glucan oligomer/polymer composition of claim 1 from the product mixture comprising glucose oligomers; and
d. optionally concentrating the soluble α-glucan oligomer/polymer composition.

A method according to any of the above embodiments wherein the glucosyltransferase is obtained from *Streptococcus salivarius*, preferably having an amino acid sequence selected from SEQ ID NOs: 3, 5 and a combination thereof.

A product produced by any of the above process embodiments; preferably wherein the product produced is the soluble α-glucan oligomer/polymer composition of the first embodiment.

EXAMPLES

Unless defined otherwise herein, all technical and scientific terms used herein have the same meaning as commonly understood by one of ordinary skill in the art to which this disclosure belongs. Singleton, et al., *DICTIONARY OF MICROBIOLOGY AND MOLECULAR BIOLOGY,* 2D ED., John Wiley and Sons, New York (1994), and Hale & Marham, *THE HARPER COLLINS DICTIONARY OF*

*BIOLOGY*, Harper Perennial, N.Y. (1991) provide one of skill with a general dictionary of many of the terms used in this disclosure.

The present disclosure is further defined in the following Examples. It should be understood that these Examples, while indicating preferred embodiments of the disclosure, are given by way of illustration only. From the above discussion and these Examples, one skilled in the art can ascertain the essential characteristics of this disclosure, and without departing from the spirit and scope thereof, can make various changes and modifications of the disclosure to adapt it to various uses and conditions.

The meaning of abbreviations is as follows: "sec" or "s" means second(s), "ms" mean milliseconds, "min" means minute(s), "h" or "hr" means hour(s), "μL" means microliter(s), "mL" means milliliter(s), "L" means liter(s); "mL/min" is milliliters per minute; "μg/mL" is microgram(s) per milliliter(s); "LB" is Luria broth; "μm" is micrometers, "nm" is nanometers; "OD" is optical density; "IPTG" is isopropyl-β-D-thio-galactoside; "g" is gravitational force; "mM" is millimolar; "SDS-PAGE" is sodium dodecyl sulfate polyacrylamide; "mg/mL" is milligrams per milliliters; "N" is normal; "w/v" is weight for volume; "DTT" is dithiothreitol; "BCA" is bicinchoninic acid; "DMAc" is N,N'-dimethyl acetamide; "LiCl" is Lithium chloride; "NMR" is nuclear magnetic resonance; "DMSO" is dimethylsulfoxide; "SEC" is size exclusion chromatography; "GI" or "gi" means GenInfo Identifier, a system used by GENBANK® and other sequence databases to uniquely identify polynucleotide and/or polypeptide sequences within the respective databases; "DPx" means glucan degree of polymerization having "x" units in length; "ATCC" means American Type Culture Collection (Manassas, VA), "DSMZ" and "DSM" will refer to Leibniz Institute DSMZ-German Collection of Microorganisms and Cell Cultures, (Braunschweig, Germany); "EELA" is the Finish Food Safety Authority (Helsinki, Finland;) "CCUG" refer to the Culture Collection, University of Göteborg, Sweden; "Suc." means sucrose; "Gluc." means glucose; "Fruc." means fructose; "Leuc." means leucrose; and "Rxn" means reaction.

General Methods

Standard recombinant DNA and molecular cloning techniques used herein are well known in the art and are described by Sambrook, J. and Russell, D., *Molecular Cloning: A Laboratory Manual*, Third Edition, Cold Spring Harbor Laboratory Press, Cold Spring Harbor, NY (2001); and by Silhavy, T. J., Bennan, M. L. and Enquist, L. W., *Experiments with Gene Fusions*, Cold Spring Harbor Laboratory Cold Press Spring Harbor, N Y (1984); and by Ausubel, F. M. et. al., *Short Protocols in Molecular Biology*, 5th Ed. Current Protocols and John Wiley and Sons, Inc., N.Y., 2002.

Materials and methods suitable for the maintenance and growth of bacterial cultures are also well known in the art. Techniques suitable for use in the following Examples may be found in *Manual of Methods for General Bacteriology*, Phillipp Gerhardt, R. G. E. Murray, Ralph N. Costilow, Eugene W. Nester, Willis A. Wood, Noel R. Krieg and G. Briggs Phillips, eds., (American Society for Microbiology Press, Washington, DC (1994)), *Biotechnology: A Textbook of Industrial Microbiology* by Wulf Crueger and Anneliese Crueger (authors), Second Edition, (Sinauer Associates, Inc., Sunderland, MA (1990)), and *Manual of Industrial Microbiology and Biotechnology*, Third Edition, Richard H. Baltz, Arnold L. Demain, and Julian E. Davis (Editors), (American Society of Microbiology Press, Washington, DC (2010).

All reagents, restriction enzymes and materials used for the growth and maintenance of bacterial cells were obtained from BD Diagnostic Systems (Sparks, MD), Invitrogen/Life Technologies Corp. (Carlsbad, CA), Life Technologies (Rockville, MD), QIAGEN (Valencia, CA), Sigma-Aldrich Chemical Company (St. Louis, MO) or Pierce Chemical Co. (A division of Thermo Fisher Scientific Inc., Rockford, IL) unless otherwise specified. IPTG, (cat #16758) and triphenyltetrazolium chloride were obtained from the Sigma Co., (St. Louis, MO). Bellco spin flask was from the Bellco Co., (Vineland, NJ). LB medium was from Becton, Dickinson and Company (Franklin Lakes, New Jersey). BCA protein assay was from Sigma-Aldrich (St Louis, MO).

Growth of Recombinant *E. coli* Strains for Production of GTF Enzymes

*Escherichia coli* strains expressing a functional GTF enzyme were grown in shake flask using LB medium with ampicillin (100 μg/mL) at 37° C. and 220 rpm to $OD_{600nm}$=0.4-0.5, at which time isopropyl-β-D-thio-galactoside (IPTG) was added to a final concentration of 0.5 mM and incubation continued for 2-4 hr at 37° C. Cells were harvested by centrifugation at 5,000×g for 15 min and resuspended (20%-25% wet cell weight/v) in 50 mM phosphate buffer pH 7.0). Resuspended cells were passed through a French Pressure Cell (SLM Instruments, Rochester, NY) twice to ensure >95% cell lysis. Cell lysate was centrifuged for 30 min at 12,000×g and 4° C. The resulting supernatant (cell extract) was analyzed by the BCA protein assay and SDS-PAGE to confirm expression of the GTF enzyme, and the cell extract was stored at −80° C.

pHYT Vector

The pHYT vector backbone is a replicative *Bacillus subtilis* expression plasmid containing the *Bacillus subtilis* aprE promoter. It was derived from the *Escherichia coli-Bacillus subtilis* shuttle vector pHY320PLK (GENBANK® Accession No. D00946 and is commercially available from Takara Bio Inc. (Otsu, Japan)). The replication origin for *Escherichia coli* and ampicillin resistance gene are from pACYC177 (GENBANK® X06402 and is commercially available from New England Biolabs Inc., Ipswich, MA). The replication origin for *Bacillus subtilis* and tetracycline resistance gene were from pAMalpha-1 (Francia et al., *J Bacteriol.* 2002 September; 184(18):5187-93)).

To construct pHYT, a terminator sequence: 5'-ATAAAAAACGCTCGGTTGCCGCCGGGCGTTTTTTAT-3' (SEQ ID NO: 1) from phage lambda was inserted after the tetracycline resistance gene. The entire expression cassette (EcoRI-BamHI fragment) containing the aprE promoter-AprE signal peptide sequence-coding sequence encoding the enzyme of interest (e.g., coding sequences for various GTFs)-BPN' terminator was cloned into the EcoRI and HindIII sites of pHYT using a BamHI-HindIII linker that destroyed the HindIII site. The linker sequence is 5'-GGATCCTGACTGCCTGAGCTT-3' (SEQ ID NO: 2). The aprE promoter and AprE signal peptide sequence (SEQ ID NO: 25) are native to *Bacillus subtilis*. The BPN' terminator is from subtilisin of *Bacillus amyloliquefaciens*. In the case when native signal peptide was used, the AprE signal peptide was replaced with the native signal peptide of the expressed gene.

Biolistic Transformation of *T. reesei*

A *Trichoderma reesei* spore suspension was spread onto the center ~6 cm diameter of an acetamidase transformation plate (150 μL of a $5\times10^7$-$5\times10^8$ spore/mL suspension). The plate was then air dried in a biological hood. The stopping screens (BioRad 165-2336) and the macrocarrier holders (BioRad 1652322) were soaked in 70% ethanol and air dried. DRIERITE® desiccant (calcium sulfate desiccant; W. A. Hammond DRIERITE® Company, Xenia, OH) was placed in small Petri dishes (6 cm Pyrex) and overlaid with Whatman filter paper (GE Healthcare Bio-Sciences, Pittsburgh, PA). The macrocarrier holder containing the macrocarrier (BioRad 165-2335; Bio-Rad Laboratories, Hercules, CA) was placed flatly on top of the filter paper and the Petri dish lid replaced. A tungsten particle suspension was prepared by adding 60 mg tungsten M-10 particles (microcarrier, 0.7 micron, BioRad #1652266, Bio-Rad Laboratories) to an Eppendorf tube. Ethanol (1 mL) (100%) was added. The tungsten was vortexed in the ethanol solution and allowed to soak for 15 minutes. The Eppendorf tube was microfuged briefly at maximum speed to pellet the tungsten. The ethanol was decanted and washed three times with sterile distilled water. After the water wash was decanted the third time, the tungsten was resuspended in 1 mL of sterile 50% glycerol. The transformation reaction was prepared by adding 25 μL suspended tungsten to a 1.5 mL-Eppendorf tube for each transformation. Subsequent additions were made in order, 2 μL DNA pTrex3 expression vectors (SEQ ID NO: 3; see U.S. Pat. No. 6,426,410), 25 μL 2.5M $CaCl_2$), 10 μL 0.1 M spermidine. The reaction was vortexed continuously for 5-10 minutes, keeping the tungsten suspended. The Eppendorf tube was then microfuged briefly and decanted. The tungsten pellet was washed with 200 μL of 70% ethanol, microfuged briefly to pellet and decanted. The pellet was washed with 200 μL of 100% ethanol, microfuged briefly to pellet, and decanted. The tungsten pellet was resuspended in 24 μL 100% ethanol. The Eppendorf tube was placed in an ultrasonic water bath for 15 seconds and 8 μL aliquots were transferred onto the center of the desiccated macrocarriers. The macrocarriers were left to dry in the desiccated Petri dishes.

A Helium tank was turned on to 1500 psi (~10.3 MPa). 1100 psi (~7.58 MPa) rupture discs (BioRad 165-2329) were used in the Model PDS-1000/He™ BIOLISTIC® Particle Delivery System (BioRad). When the tungsten solution was dry, a stopping screen and the macrocarrier holder were inserted into the PDS-1000. An acetamidase plate, containing the target *T. reesei* spores, was placed 6 cm below the stopping screen. A vacuum of 29 inches Hg (~98.2 kPa) was pulled on the chamber and held. The He BIOLISTIC® Particle Delivery System was fired. The chamber was vented and the acetamidase plate removed for incubation at 28° C. until colonies appeared (5 days).

Modified amdS Biolistic Agar (MABA) Per Liter

- Part I, make in 500 mL distilled water ($dH_2O$)
- 1000× salts 1 mL
- Noble agar 20 g
- pH to 6.0, autoclave
- Part II, make in 500 mL $dH_2O$
- Acetamide 0.6 g
- CsCl 1.68 g
- Glucose 20 g
- $KH_2PO_4$ 15 g
- $MgSO_4 \cdot 7H_2O$ 0.6 g
- $CaCl_2$).$2H_2O$ 0.6 g
- pH to 4.5, 0.2 micron filter sterilize; leave in 50° C. oven to warm, add to agar, mix, pour plates. Stored at room temperature (~21° C.)

1000× Salts Per Liter

- $FeSO_4 \cdot 7H_2O$ 5 g
- $MnSO_4 \cdot H_2O$ 1.6 g
- $ZnSO_4 \cdot 7H_2O$ 1.4 g
- $CoCl_2 \cdot 6H_2O$ 1 g
- Bring up to 1 L $dH_2O$.
- 0.2 micron filter sterilize Determination of the Glucosyltransferase Activity Glucosyltransferase activity assay was performed by incubating 1-10% (v/v) crude protein extract containing GTF enzyme with 200 g/L sucrose in 25 mM or 50 mM sodium acetate buffer at pH 5.5 in the presence or absence of 25 g/L dextran (MW~1500, Sigma-Aldrich, Cat. #31394) at 37° C. and 125 rpm orbital shaking. One aliquot of reaction mixture was withdrawn at 1 h, 2 h and 3 h and heated at 90° C. for 5 min to inactivate the GTF. The insoluble material was removed by centrifugation at 13,000×g for 5 min, followed by filtration through 0.2 μm RC (regenerated cellulose) membrane. The resulting filtrate was analyzed by HPLC using two Aminex HPX-87C columns series at 85° C. (Bio-Rad, Hercules, CA) to quantify sucrose concentration. The sucrose concentration at each time point was plotted against the reaction time and the initial reaction rate was determined from the slope of the linear plot. One unit of GTF activity was defined as the amount of enzyme needed to consume one micromole of sucrose in one minute under the assay condition.

Determination of the α-Glucanohydrolase Activity

Insoluble mutan polymers required for determining mutanase activity were prepared using secreted enzymes produced by *Streptococcus sobrinus* ATCC® 33478™. Specifically, one loop of glycerol stock of *S. sobrinus* ATCC® 33478™ was streaked on a BHI agar plate (Brain Heart Infusion agar, Teknova, Hollister, CA), and the plate was incubated at 37° C. for 2 days; A few colonies were picked using a loop to inoculate 2×100 mL BHI liquid medium in the original medium bottle from Teknova, and the culture was incubated at 37° C., static for 24 h. The resulting cells were removed by centrifugation and the resulting supernatant was filtered through 0.2 μm sterile filter; 2×101 mL of filtrate was collected. To the filtrate was added 2×11.2 mL of 200 g/L sucrose (final sucrose 20 g/L). The reaction was incubated at 37° C., with no agitation for 67 h. The resulting polysaccharide polymers were collected by centrifugation at 5000×g for 10 min. The supernatant was carefully decanted. The insoluble polymers were washed 4 times with 40 mL of sterile water. The resulting mutan polymers were lyophilized for 48 h. Mutan polymer (390 mg) was suspended in 39 mL of sterile water to make suspension of 10 mg/mL. The mutan suspension was homogenized by sonication (40% amplitude until large lumps disappear, ~10 min in total). The homogenized suspension was aliquoted and stored at 4° C.

A mutanase assay was initiated by incubating an appropriate amount of enzyme with 0.5 mg/mL mutan polymer (prepared as described above) in 25 mM KOAc buffer at pH 5.5 and 37° C. At various time points, an aliquot of reaction mixture was withdrawn and quenched with equal volume of 100 mM glycine buffer (pH 10). The insoluble material in each quenched sample was removed by centrifugation at 14,000×g for 5 min. The reducing ends of oligosaccharide and polysaccharide polymer produced at each time point were quantified by the p-hydroxybenzoic acid hydrazide solution (PAHBAH) assay (Lever M., *Anal. Biochem.*, (1972) 47:273-279) and the initial rate was determined from the slope of the linear plot of the first three or four time points of the time course. The PAHBAH assay was performed by adding 10 μL of reaction sample supernatant to 100 μL of PAHBAH working solution and heated at 95° C. for 5 min. The working solution was prepared by mixing one part of reagent A (0.05 g/mL p-hydroxy benzoic acid hydrazide and 5% by volume of concentrated hydrochloric acid) and four parts of reagent B (0.05 g/mL NaOH, 0.2 g/mL sodium potassium tartrate). The absorption at 410 nm was recorded and the concentration of the reducing ends was calculated by subtracting appropriate background absorption and using a standard curve generated with various concentrations of glucose as standards. A Unit of mutanase activity is defined as the conversion of 1 micromole/min of mutan polymer at pH 5.5 and 37° C., determined by measuring the increase in reducing ends as described above.

Determination of Glycosidic Linkages

One-dimensional $^1$H NMR data were acquired on a Varian Unity Inova system (Agilent Technologies, Santa Clara, CA) operating at 500 MHz using a high sensitivity cryoprobe. Water suppression was obtained by carefully placing the observe transmitter frequency on resonance for the residual water signal in a "presat" experiment, and then using the "tnnoesy" experiment with a full phase cycle (multiple of 32) and a mix time of 10 ms.

Typically, dried samples were taken up in 1.0 mL of D20 and sonicated for 30 min. From the soluble portion of the sample, 100 µL was added to a 5 mm NMR tube along with 350 µL $D_2O$ and 100 µL of $D_2O$ containing 15.3 mM DSS (4,4-dimethyl-4-silapentane-1-sulfonic acid sodium salt) as internal reference and 0.29% $NaN_3$ as bactericide. The abundance of each type of anomeric linkage was measured by the integrating the peak area at the corresponding chemical shift. The percentage of each type of anomeric linkage was calculated from the abundance of the particular linkage and the total abundance anomeric linkages from oligosaccharides.

Methylation Analysis

The distribution of glucosidic linkages in glucans was determined by a well-known technique generally named "methylation analysis," or "partial methylation analysis" (see: F. A. Pettolino, et al., *Nature Protocols*, (2012) 7(9): 1590-1607). The technique has a number of minor variations but always includes: 1. methylation of all free hydroxyl groups of the glucose units, 2. hydrolysis of the methylated glucan to individual monomer units, 3. reductive ring-opening to eliminate anomers and create methylated glucitols; the anomeric carbon is typically tagged with a deuterium atom to create distinctive mass spectra, 4. acetylation of the free hydroxyl groups (created by hydrolysis and ring opening) to create partially methylated glucitol acetates, also known as partially methylated products, 5. analysis of the resulting partially methylated products by gas chromatography coupled to mass spectrometry and/or flame ionization detection.

The partially methylated products include non-reducing terminal glucose units, linked units and branching points. The individual products are identified by retention time and mass spectrometry. The distribution of the partially-methylated products is the percentage (area %) of each product in the total peak area of all partially methylated products. The gas chromatographic conditions were as follows: RTx-225 column (30 m×250 µm ID×0.1 µm film thickness, Restek Corporation, Bellefonte, PA, USA), helium carrier gas (0.9 mL/min constant flow rate), oven temperature program starting at 80° C. (hold for 2 min) then 30° C./min to 170° C. (hold for 0 min) then 4° C./min to 240° C. (hold for 25 min), 1 µL injection volume (split 5:1), detection using electron impact mass spectrometry (full scan mode)

Viscosity Measurement

The viscosity of 12 wt % aqueous solutions of soluble oligomer/polymer was measured using a TA Instruments AR-G2 controlled-stress rotational rheometer (TA Instruments—Waters, LLC, New Castle, DE) equipped with a cone and plate geometry. The geometry consists of a 40 mm 2° upper cone and a peltier lower plate, both with smooth surfaces. An environmental chamber equipped with a water-saturated sponge was used to minimize solvent (water) evaporation during the test. The viscosity was measured at 20° C. The peltier was set to the desired temperature and 0.65 mL of sample was loaded onto the plate using an Eppendorf pipette (Eppendorf North America, Hauppauge, NY). The cone was lowered to a gap of 50 µm between the bottom of the cone and the plate. The sample was thermally equilibrated for 3 minutes. A shear rate sweep was performed over a shear rate range of 500-10 $s^{-1}$. Sample stability was confirmed by running repeat shear rate points at the end of the test.

Determination of the Concentration of Sucrose, Glucose, Fructose and Leucrose

Sucrose, glucose, fructose, and leucrose were quantitated by HPLC with two tandem Aminex HPX-87C Columns (Bio-Rad, Hercules, CA). Chromatographic conditions used were 85° C. at column and detector compartments, 40° C. at sample and injector compartment, flow rate of 0.6 mL/min, and injection volume of 10 µL. Software packages used for data reduction were EMPOWER™ version 3 from Waters (Waters Corp., Milford, MA). Calibrations were performed with various concentrations of standards for each individual sugar.

Determination of the Concentration of Oligosaccharides

Soluble oligosaccharides were quantitated by HPLC with two tandem Aminex HPX-42A columns (Bio-Rad). Chromatographic conditions used were 85° C. column temperature and 40° C. detector temperature, water as mobile phase (flow rate of 0.6 mL/min), and injection volume of 10 µL. Software package used for data reduction was EMPOWER™ version 3 from Waters Corp. Oligosaccharide samples from DP2 to DP7 were obtained from Sigma-Aldrich: maltoheptaose (DP7, Cat. #47872), maltohexanose (DP6, Cat. #47873), maltopentose (DPS, Cat. #47876), maltotetraose (DP4, Cat. #47877), isomaltotriose (DP3, Cat. #47884) and maltose (DP2, Cat. #47288). Calibration was performed for each individual oligosaccharide with various concentrations of the standard.

Purification of Soluble Oligosaccharide

Soluble oligosaccharide present in product mixtures produced by the conversion of sucrose using glucosyltransferase enzymes with or without added mutanases as described in the following examples were purified and isolated by size-exclusion column chromatography (SEC). In a typical procedure, product mixtures were heat-treated at 60° C. to 90° C. for between 15 min and 30 min and then centrifuged at 4000 rpm for 10 min. The resulting supernatant was injected onto an AKTAprime purification system (SEC; GE Healthcare Life Sciences) (10 mL-50 mL injection volume) connected to a GE HK 50/60 column packed with 1.1 L of Bio-Gel P2 Gel (Bio-Rad, Fine 45-90 µm) using water as eluent at 0.7 mL/min. The SEC fractions (~5 mL per tube) were analyzed by HPLC for oligosaccharides using a Bio-Rad HPX-47A column. Fractions containing >DP2 oligosaccharides were combined and the soluble oligomer/polymer isolated by rotary evaporation of the combined fractions to produce a solution containing between 3% and 6% (w/w) solids, where the resulting solution was lyophilized to produce the soluble oligomer/polymer as a solid product.

Example 1

Construction of Glucosyltransferase (GTF-J) Expression Strain *E. coli* MG1655/pMP52

The polynucleotide sequence encoding the mature glucosyltransferase enzyme (gtf-J; EC 2.4.1.5; SEQ ID NO: 3)

from *Streptococcus salivarius* (ATCC® 25975™) as reported in GEN BANK® (accession M64111.1; gi:47527) was synthesized using codons optimized for expression in *E. coli* (DNA 2.0, Menlo Park, CA). The nucleic acid product (SEQ ID NO: 4) encoding the mature enzyme (i.e., signal peptide removed and a start codon added; SEQ ID NO: 5) was subcloned into PJEXPRESS404® (DNA 2.0, Menlo Park CA) to generate the plasmid identified as pMP52. The plasmid pMP52 was used to transform *E. coli* MG1655 (ATCC® 47076™) to generate the strain identified as MG1655/pMP52. All procedures used for construction of the glucosyltransferase enzyme expression strain are well known in the art and can be performed by individuals skilled in the relevant art without undue experimentation.

Example 2

Production of Recombinant Gtf-J in Fermentation

Production of the recombinant mature glucosyltransferase Gtf-J in a fermentor was initiated by preparing a pre-seed culture of the *E. coli* strain MG1655/pMP52, expressing the mature Gtf-J enzyme (GI:47527; "GTF7527"; SEQ ID NO: 5), constructed as described in Example 1. A 10-mL aliquot of the seed medium was added into a 125-mL disposable baffled flask and was inoculated with a 1.0 mL culture of *E. coli* MG1655/pMP52 in 20% glycerol. This culture was allowed to grow at 37° C. while shaking at 300 rpm for 3 h.

A seed culture for starting the fermentor was prepared by charging a 2-L shake flask with 0.5 L of the seed medium. 1.0 mL of the pre-seed culture was aseptically transferred into 0.5 L seed medium in the flask and cultivated at 37° C. and 300 rpm for 5 h. The seed culture was transferred at optical density >2 (0D550) to a 14-L fermentor (Braun, Perth Amboy, NJ) containing 8 L of the fermentor medium described above at 37° C.

Cells of *E. coli* MG1655/pMP52 were allowed to grow in the fermentor and glucose feed (50% w/w glucose solution containing 1% w/w $MgSO_4 \cdot 7H_2O$) was initiated when glucose concentration in the medium decreased to 0.5 g/L. The feed was started at 0.36 grams feed per minute (g feed/min) and increased progressively each hour to 0.42, 0.49, 0.57, 0.66, 0.77, 0.90, 1.04, 1.21, 1.41 1.63, 1.92, 2.2 g feed/min respectively. The rate remained constant afterwards. Glucose concentration in the medium was monitored using an YSI glucose analyzer (YSI, Yellow Springs, Ohio). When glucose concentration exceeded 0.1 g/L the feed rate was decreased or stopped temporarily. Induction of glucosyltransferase enzyme activity was initiated, when cells reached an $OD_{550}$ of 70, with the addition of 9 mL of 0.5 M IPTG (isopropyl β-D-1-thiogalacto-pyranoside). The dissolved oxygen (DO) concentration was controlled at 25% of air saturation. The DO was controlled first by impeller agitation rate (400 to 1200 rpm) and later by aeration rate (2 to 10 standard liters per minute, slpm). The pH was controlled at 6.8. $NH_4OH$ (14.5% weight/volume, w/v) and $H_2SO_4$ (20% w/v) were used for pH control. The back pressure was maintained at 0.5 bar. At various intervals (20, 25 and 30 hours), 5 mL of Suppressor 7153 antifoam (Cognis Corporation, Cincinnati, OH) was added into the fermentor to suppress foaming. Cells were harvested by centrifugation 8 h post IPTG addition and were stored at −80° C. as a cell paste.

Example 3

Preparation of Gtf-J Crude Protein Extract from Cell Paste

The cell paste obtained as described in Example 2 was suspended at 150 g/L in 50 mM potassium phosphate buffer (pH 7.2) to prepare a slurry. The slurry was homogenized at 12,000 psi (~82.7 MPa; Rannie-type machine, APV-1000 or APV 16.56; SPX Corp., Charlotte, North Carolina) and the homogenate chilled to 4° C. With moderately vigorous stirring, 50 g of a floc solution (Aldrich no. 409138, 5% in 50 mM sodium phosphate buffer pH 7.0) was added per liter of cell homogenate. Agitation was reduced to light stirring for 15 minutes. The cell homogenate was then clarified by centrifugation at 4500 rpm for 3 hours at 5-10° C. Supernatant, containing Gtf-J enzyme in the crude protein extract, was concentrated (approximately 5×) with a 30 kilodalton (kDa) cut-off membrane. The concentration of total soluble protein in the Gtf-J crude protein extract was determined to be 4-8 g/L using the bicinchoninic acid (BCA) protein assay (Sigma Aldrich).

Example 4

Production of Gtf-J GI:47527 in *E. coli* TOP10

The plasmid pMP52 (Example 1) was used to transform *E. coli* TOP10 (Life Technologies Corp., Carlsbad, CA) to generate the strain identified as TOP10/pMP52. Growth of the *E. coli* strain TOP10/pMP52 expressing the mature Gtf-J enzyme "GTF7527" (provided as SEQ ID NO: 5) and determination of the GTF activity followed the methods described above.

Example 5

Production of Gtf-L GI:662379 in *E. coli* TOP10

A polynucleotide encoding a truncated version of a glucosyltransferase (Gtf) enzyme identified in GENBANK® as GI:662379 (SEQ ID NO: 6; Gtf-L from *Streptococcus salivarius*) was synthesized using codons optimized for expression in *E. coli* (DNA 2.0, Menlo Park CA). The nucleic acid product (SEQ ID NO: 7) encoding protein "GTF2379" (SEQ ID NO: 8), was subcloned into PJEXPRESS404® (DNA 2.0) to generate the plasmid identified as pMP65. The plasmid pMP65 was used to transform *E. coli* TOP10 (Life Technologies Corp.) to generate the strain identified as TOP10/pMP65. Growth of the *E. coli* strain TOP10/pMP65 expressing the gtf enzyme "2379" (last 4 digits of the respective GI number used) and determination of the Gtf activity followed the methods described above.

Example 6

PRODUCTION OF GTF-B GI:290580544 IN *E. coli* TOP10

A polynucleotide encoding a truncated version of a glucosyltransferase enzyme identified in GENBANK® as GI:290580544 (SEQ ID NO: 9; Gtf-B from *Streptococcus mutans* NN2025) was synthesized using codons optimized for expression in *E. coli* (DNA 2.0). The nucleic acid product (SEQ ID NO: 10) encoding protein "GTF0544" (SEQ ID NO: 11) was subcloned into PJEXPRESS404® to generate the plasmid identified as pMP67. The plasmid pMP67 was used to transform *E. coli* TOP10 to generate the strain identified as TOP10/pMP67. Growth of the *E. coli* strain TOP10/pMP67 expressing the Gtf-B enzyme "GTF0544" (SEQ ID NO: 11) and determination of the GTF0544 activity followed the methods described above.

Example 7

Production of Gtf-I GI:450874 in *E. coli* BL21 DE3

A polynucleotide encoding a glucosyltransferase from *Streptococcus sobrinus*, (ATCC® 27351™) was isolated using polymerase chain reaction (PCR) methods well known in the art. PCR primers were designed based on gene sequence described in GENBANK® accession number BAA14241 and by Abo et al., (*J. Bacteriol*., (1991) 173: 998-996). The 5'-end primer 5'-GGGAATTCCCAGGTTGACGGTAAATATTATTACT-3' (SEQ ID NO: 12) was designed to code for sequence corresponded to bases 466 through 491 of the gtf-I gene. Additionally, the primer contained sequence for an EcoRI restriction enzyme site which was used for cloning purposes.

The 3'-End Primer 5'-AGATCTAGTCTTAGTTCCAGCCACGGTACATA-3' (SEQ ID NO: 13) was designed to code for sequence corresponded to the reverse compliment of bases 4749 through 4774 of *S. sobrinus* gene. The reverse PCR primer also included the sequence for an XbaI site, used for cloning purposes. The resulting 4.31 Kb DNA fragment was digested with EcoRI and Xba I restriction enzymes and purified using a Promega PCR Clean-up kit (A9281, Promega Corp., Madison, WI) as recommended by the manufacturer. The DNA fragment was ligated into an *E. coli* protein expression vector (pET24a, Novagen, a divisional of Merck KGaA, Darmstadt, Germany). The ligated reaction was transformed into the BL21 DE3 cell line (New England Biolabs, Ipswich, MA) and plated on solid LB medium (10 g/L, tryptone; 5 g/L yeast extract; 10 g/L NaCl; 14% agar; 100 μg/mL ampicillin) for selection of single colonies.

Transformed *E. coli* BL21 DE3 cells were inoculated to an initial optical density (OD at 600 nm) of 0.025 in LB media and were allowed to grow at 37° C. in an incubator while shaking at 250 rpm. When cultures reached an OD of 0.8-1.0, the gene (SEQ ID NO: 15) encoding the truncated Gtf-I enzyme (SEQ ID NO: 16) was induced by addition of 1 mM IPTG. Induced cultures remained on the shaker and were harvested 3 h post induction. Cells were harvested by centrifugation (25° C., 16,000 rpm) using an Eppendorf centrifuge. Cell pellets were suspended at 0.01 volume in 5.0 mM phosphate buffer (pH 7.0) and cooled to 4° C. on ice. The cells were broken using a bead beater with 0.1 millimeters (mm) silica beads. Cell debris was removed by centrifuged (16,000 rpm for 10 minutes at 4° C.). The crude protein extract (containing soluble Gtf-I ("GTF0874") enzyme) was aliquoted and stored at −80° C.

Example 8

Production of Gtf-I Enzyme GI:450874 in *E. coli* TOP10

The gene encoding a truncated version of a glucosyltransferase enzyme identified in GENBANK® as GI:450874 (SEQ ID NO: 14; Gtf-I from *Streptococcus sobrinus*) was synthesized using codons optimized for expression in *E. coli* (DNA 2.0). The nucleic acid product (SEQ ID NO: 15) encoding the truncated glucosyltransferase ("GTF0874"; SEQ ID NO: 16) was subcloned into PJEXPRESS404® to generate the plasmid identified as pMP53. The plasmid pMP53 was used to transform *E. coli* TOP10 to generate the strain identified as TOP10/pMP53. Growth of the *E. coli* strain TOP10/pMP53 expressing the Gtf-I enzyme "GTF0874" and determination of Gtf activity followed the methods described above.

Example 9

Production of Gtf-S Enzyme GI: 495810459 in *E. coli* TOP10

A gene encoding a truncated version of a glucosyltransferase enzyme identified in GENBANK® as GI:495810459 (SEQ ID NO: 17; Gtf-S from *Streptococcus* sp. C150) was synthesized using codons optimized for expression in *E. coli* (DNA 2.0). The nucleic acid product (SEQ ID NO: 18) encoding the truncated glucosyltransferase ("GTF0459"; SEQ ID NO: 19) was subcloned into PJEXPRESS404® to generate the plasmid identified as pMP79. The plasmid pMP79 was used to transform *E. coli* TOP10 to generate the strain identified as TOP10/pMP79. Growth of the *E. coli* strain TOP10/pMP79 expressing the Gtf-S enzyme and determination of the Gtf activity followed the methods described above.

Example 10

Production of Gtf-S Enzyme GI: 495810459 in *B. subtilis* BG6006

SG1067-2 is a *Bacillus subtilis* expression strain that expresses a truncated version of the glycosyltransferase Gtf-S ("GTF0459") from *Streptococcus* sp. C150 (GI: 495810459). The *B. subtilis* host BG6006 strain contains 9 protease deletions (amyE::xylRPxylAcomK-ermC, degUHy32, oppA, ΔspoIIE3501, ΔaprE, ΔnprE, Δepr, ΔispA, Δbpr, Δvpr, ΔwprA, Δmpr-ybfJ, ΔnprB). The full length Gtf-A has 1570 amino acids. The N terminal truncated version with 1393 amino acids was originally codon optimized for *E. coli* expression and synthesized by DNA2.0. This N terminal truncated Gtf-S(SEQ ID NO: 19) was subcloned into the NheI and HindIII sites of the replicative *Bacillus* expression pHYT vector under the aprE promoter and fused with the *B. subtilis* AprE signal peptide on the vector. The construct was first transformed into *E. coli* DH10B and selected on LB with ampicillin (100 μg/mL) plates. The confirmed construct pDCQ967 expressing the Gtf was then transformed into *B. subtilis* BG6006 and selected on the LB plates with tetracycline (12.5 μg/mL). The resulting *B. subtilis* expression strain SG1067 was purified and one of isolated cultures, SG1067-2, was used as the source of the Gtf-S enzyme. SG1067-2 strain was first grown in LB media containing 10 μg/mL tetracycline, and then subcultured into GrantsII medium containing 12.5 μg/mL tetracycline grown at 37° C. for 2-3 days. The cultures were spun at 15,000 g for 30 min at 4° C. and the supernatant was filtered through 0.22 μm filters. The filtered supernatant containing GTF0459 was aliquoted and frozen at −80° C.

Example 11

Fermentation of *B. subtilis* SG1067-2 to Produce Gtf-S GI:495810459

*B. subtilis* SG1067-2 strain (Example 10), expressing GTF0459 (SEQ ID NO: 19), was grown under an aerobic submerged condition by conventional fed-batch fermentation. A nutrient medium contains 0-15% HY-SOY™ (a highly soluble, multi-purpose, enzymatic hydrolysate of soy meal; Kerry Inc., Beloit, WI), 5-25 g/L sodium and potassium phosphate, 0.5-4 g/L magnesium sulfate, and citric acid, ferrous sulfate and manganese sulfate. An antifoam agent, FOAM BLAST® 882 (a food grade polyether polyol defoamer aid; Emerald Performance Materials, LLC, Cuyahoga Falls, OH), of 3-5 mL/L was added to control foaming. 2-L fermentation was fed with 50% w/w glucose feed when initial glucose in batch was non-detectable. The glucose feed rate was ramped over several hours. The fermentation was controlled at 37° C. and 20% DO, and initiated at the initial agitation of 400 rpm. The pH was controlled at 7.2 using 50% v/v ammonium hydroxide. Fermentation parameters such as pH, temperature, airflow, DO % were monitored throughout the entire 2-day fermentation run. The culture broth was harvested at the end of run and centrifuged at 5° C. to obtain supernatant. The supernatant containing GTF0459 was then frozen and stored at −80° C.

Example 11A

Construction of *Bacillus subtilis* Strains Expressing Homolog Genes of GTF0459

A search was carried out to identify sequences homologous to GTF0459. Beginning with the GTF0459 sequence, homologous sequences were identified by carrying out a BLAST search against the non-redundant NCBI protein database as of Sep. 8, 2014. The BLAST run identified about 1100 putative homologs using an e-value cutoff of 1e-10. After filtering for alignments of at least 1000 amino acids in length and sorting based on percentage amino acid sequence identity, 13 homologs were found which were closely related, i.e., had greater than 90% amino acid sequence identity, to GTF0459. The identified homologs were then aligned to the GTF0459 sequence by using CLUSTALW, a standard sequence alignment package for aligning very highly related sequences. The homologous sequences are around 96-97% identical to the amino acid sequence of GTF0459 in the aligned region of 1570 residues. The aligned region extends from amino acid position 1 to 1570 in GTF0459 and positions 1 to 1581 in the GTF0459 homologs. Beyond the 13 identified GTF0459 homologs, the next closest proteins share only about 55% amino acid sequence identity in the aligned region to GTF0459 or any of the 13 identified homologs. The DNA sequences encoding N terminal variable region truncated proteins of GTF0459 and the homologs (SEQ ID NOs. 86 and the odd numbered SEQ ID NOs between 87 and 111) and two non-homologs (<54% aa sequence identity) (SEQ ID NOs. 113, 115) as provided in the table 1 below were synthesized by Genscript. The synthetic genes were cloned into the NheI and HindIII sites of the *Bacillus subtilis* integrative expression plasmid p4JH under the aprE promoter and fused with the *B. subtilis* AprE signal peptide on the vector. In some cases, they were cloned into the SpeI and HindIII sites of the *Bacillus subtilis* integrative expression plasmid p4JH under the aprE promoter without a signal peptide. The constructs were first transformed into *E. coli* DH10B and selected on LB with ampicillin (100 ug/ml) plates. The confirmed constructs expressing the particular GTFs were then transformed into *B. subtilis* host containing 9 protease deletions (amyE::xylRPxylAcomK-ermC, degUHy32, oppA, ΔspoIIE3501, ΔaprE, ΔnprE, Δepr, ΔispA, Δbpr, Δvpr, ΔwprA, Δmpr-ybfJ, ΔnprB) and selected on the LB plates with chloramphenicol (5 ug/ml). The colonies grown on LB plates with 5 ug/ml chloramphenicol were streaked several times onto LB plates with 25 ug/ml chloramphenicol. The resulting *B. subtilis* expression strains were grown in LB medium with 5 ug/ml chloramphenicol first and then subcultured into GrantsII medium grown at 30° C. for 2-3 days. The cultures were spun at 15,000 g for 30 min at 4° C. and the supernatants were filtered through 0.22 urn filters. The filtered supernatants were aliquoted and frozen at −80° C.

TABLE 1

GTF0459 and sequences identified during homolog search (GTF numbering based on last four digits of GI number)

| GI number | New GI number | % identity | Source organisms | DNA seq SEQ ID | aa seq SEQ ID |
|---|---|---|---|---|---|
| 322373279 | 495810459; 321278321 | 100.00 | *Streptococcus* sp. C150 | 86 | 19 |
| 488980470 | | 97.41 | *Streptococcus salivarius* K12 | 87 | 88 |
| 488977317 | | 97.56 | *Streptococcus salivarius* PS4 | 89 | 90 |
| 544721645 | | 97.13 | *Streptococcus* sp. HSISS3 | 91 | 92 |
| 544716099 | | 97.27 | *Streptococcus* sp. HSISS2 | 93 | 94 |
| 660358467 | | 96.98 | *Streptococcus salivarius* NU10 | 95 | 96 |
| 340398487 | 503756246 | 96.77 | *Streptococcus salivarius* CCHSS3 | 97 | 98 |
| 490286549 | | 96.41 | *Streptococcus salivarius* M18 | 99 | 100 |
| 544713879 | | 96.62 | *Streptococcus* sp. HSISS4 | 101 | 102 |
| 488974336 | | 96.77 | *Streptococcus salivarius* SK126 | 103 | 104 |
| 387784491 | 504447649 | 96.34 | *Streptococcus salivarius* JIM8777 | 105 | 106 |
| 573493808 | | 96.26 | *Streptococcus* sp. SR4 | 107 | 108 |
| 387760974 | 504445794 | 96.12 | *Streptococcus salivarius* 57.I | 109 | 110 |
| 576980060 | | 96.12 | *Streptococcus* sp. ACS2 | 111 | 112 |
| 495810487 | | 53 | *Streptococcus salivarius* PS4 | 113 | 114 |
| 440355360 | | 48.02 | *Streptococcus mutans* JP9-4 | 115 | 116 |

Example 11B

Construction of *Bacillus subtilis* Strains Expressing C-Terminal Truncations of GTF0459 Homolog Genes Glucosyltransferases usually contain an N terminal variable domain, a middle catalytic domain, and a C-terminal domain containing multiple glucan-binding domains. The GTF0459 homologs identified and expressed in Example 11A all contained an N terminal variable region truncation. This example describes the construction of *Bacillus subtilis* strains expressing individual C-terminal truncations of GTF0459 and GTF0459 homologs (as identified by the last four digits in the GI numbers in table 1 above).

T1 (extending from amino acid positions 179-1086), T2 (extending from amino acid positions 179-1125), T4 (extending from amino acid positions 179-1182), T5 (extending from amino acid positions 179-1183), and T6 (extending from amino acid positions 179-1191) C-terminal truncations were made from the GTF0974, GTF4336, and GTF4491 glucosyltransferases containing N-terminal truncations as listed in table 1 in Example 11A. A T5 and T6 truncation of GTF0459 (GTF3279) was also produced. A T5 truncation was also made from GTF3808. DNA and protein SEQ ID NOs for the sequences of the truncations as provided in the sequence listing are listed in table 2 below. The DNA fragments encoding GTF0459, the N-terminal truncated homologs, and the C-terminal truncations were PCR amplified from the synthetic gene plasmids by Genscript and cloned into the SpeI and HindIII sites of the *Bacillus subtilis* integrative expression plasmid p4JH under the aprE promoter without a signal peptide. The constructs were first transformed into *E. coli* DH10B and selected on LB with ampicillin (100 ug/ml) plates. The confirmed constructs expressing the particular GTFs were then transformed into *B. subtilis* host containing 9 protease deletions (amyE::xylRPxylAcomK-ermC, degUHy32, oppA, ΔspoIIE3501, ΔaprE, ΔnprE, Δepr, ΔispA, Δbpr, Δvpr, ΔwprA, Δmpr-ybfJ, ΔnprB) and selected on the LB plates with chloramphenicol (CM, 5 ug/ml). The colonies grown on LB plates with 5 ug/ml chloramphenicol were streaked several times onto LB plates with 25 ug/ml chloramphenicol. The resulting *B. subtilis* expression strains were grown in LB medium with 5 ug/ml chloramphenicol first and then subcultured into GrantsII medium grown at 30° C. for 2-3 days. The cultures were spun at 15,000 g for 30 min at 4° C. and the supernatants were filtered through 0.22 urn filters. The filtered supernatants were aliquoted and frozen at −80° C.

GTF activity of the strains was analyzed by PAHBAH assay in three separate experiments. Due to minor variations between the experiments, Table 2 lists the activity of the truncated enzymes in the *B. subtilis* host along with the experiment in which the activity was measured. Most of the T1, T2, and T6 truncations decreased the activity of the enzymes, whereas the T4 and T5 C-terminal truncations retained similar activity relative to the respective N terminal-only truncations (NT). The homologs and C-terminal truncations of the homologs maintained activity and produced a similar soluble α-glucan fiber to GTF0459 (see Examples 39A and 39B), suggesting that residues within the catalytic domain retained in the truncations may be a characteristic of enzymes capable of producing the fiber. To identify specific amino acid residues within the catalytic domain that may be involved in producing the soluble α-glucan fiber, we analyzed the crystal structures (PDB Identifiers: 3AIB, 3AIC, and 3HZ3) of the catalytic domains of three glucosyltransferases to identify residues within 8 Angstroms of the bound ligand. 57 residues met that criterion. A motif was generated based on the corresponding 57 amino acids in GTF0459 and each of the identified homologs. The motif was then used to generate a consensus sequence to capture the variability in the catalytic domains of GTF0459 and the identified homologs. The consensus sequence is provided as SEQ ID NO: 153.

TABLE 2

GTF activity of strains.

| Strain | Enzyme | Experiment Number | Acitivity, U/mL | DNA SEQ ID NO: | Amino Acid SEQ ID NO: |
|---|---|---|---|---|---|
| SG1316 | GTF0974T4 | 2 | 47.2 | 127 | 128 |
| SG1316 | GTF0974T4 | 3 | 33.9 | 127 | 128 |
| SG1317 | GTF0974T5 | 2 | 43.5 | 117 | 118 |
| SG1317 | GTF0974T5 | 3 | 37.7 | 117 | 118 |
| SG1290 | GTF0974NT | 1 | 43.7 | 109 | 110 |
| SG1290 | GTF0974NT | 2 | 53 | 109 | 110 |
| SG1290 | GTF0974NT | 3 | 36.4 | 109 | 110 |
| SG1318 | GTF4336T4 | 2 | 46.4 | 129 | 130 |
| SG1319 | GTF4336T5 | 2 | 43.6 | 119 | 120 |
| SG1291 | GTF4336NT | 1 | 34.5 | 103 | 104 |
| SG1291 | GTF4336NT | 2 | 48.6 | 103 | 104 |
| SG1320 | GTF4491T4 | 2 | 45.3 | 131 | 132 |
| SG1321 | GTF4491T5 | 2 | 50.6 | 121 | 122 |
| SG1292 | GTF4491NT | 1 | 42.3 | 105 | 106 |
| SG1292 | GTF4491NT | 2 | 53.1 | 105 | 106 |
| SG1330 | GTF3808T5 | 3 | 36.2 | 123 | 124 |
| SG1313 | GTF3808NT | 3 | 34.9 | 107 | 108 |
| SG1297 | GTF0459NTnativeT5 | 2 | 52 | 125 | 126 |
| SG1298 | GTF0459NTnativeT6 | 1 | 28.5 | 133 | 134 |
| SG1273 | GTF0459nativeNT | 1 | 26.5 | 86 | 19 |
| SG1273 | GTF0459nativeNT | 2 | 39.4 | 86 | 19 |
| SG1304 | GTF0974T1 | 1 | 18.4 | 135 | 136 |
| SG1305 | GTF0974T2 | 1 | 7.2 | 137 | 138 |
| SG1306 | GTF0974T6 | 1 | 33.7 | 139 | 140 |
| SG1307 | GTF4336T1 | 1 | 9.4 | 141 | 142 |
| SG1308 | GTF4336T2 | 1 | 11.5 | 143 | 144 |
| SG1309 | GTF4336T6 | 1 | 28.9 | 145 | 146 |
| SG1310 | GTF4991T1 | 1 | 23.1 | 147 | 148 |
| SG1311 | GTF4991T2 | 1 | 4.9 | 149 | 150 |
| SG1312 | GTF4991T6 | 1 | 1.7 | 151 | 152 |

Example 11C

Fermentation of *Bacillus subtilis* Strains Expressing Homologs of GTF0459 or C-Terminal Truncations of GTF0459 Homologs Using Soy Hydrolysate Medium A *B. subtilis* strain expressing each GTF was grown under an aerobic submerged condition by conventional fed-batch fermentation. The nutrient medium contained 1.75-7% soy hydrolysate (Sensient or BD), 5-25 g/L sodium and potassium phosphate, 0.5-4 g/L magnesium sulfate and a solution of 3-10 g/L citric acid, ferrous sulfate and manganese. An antifoam agent, Foamblast 882, at 2-4 mL/L was added to control foaming. A 2-L or 10-L fermentation was fed with 50% w/w glucose feed when initial glucose in batch was non-detectable. The glucose feed rate was ramped over several hours. The fermentation was controlled at 20% DO and temperature of 30° C., and initiated at an initial agitation of 400 rpm. The pH was controlled at 7.2 using 50% v/v ammonium hydroxide. Fermentation parameters such as pH, temperature, airflow, DO % were monitored throughout the entire 2-3 day fermentation run. The culture broth was harvested at the end of run and centrifuged to obtain supernatant containing GTF. The supernatant was then stored frozen at −80° C.

Example 11D

Fermentation of *Bacillus subtilis* Strains Expressing Homologs of GTF0459 or C-Terminal Truncations of GTF0459 Homologs Using Corn Steep Solids Medium A *B. subtilis* strain expressing each GTF was grown under an aerobic submerged condition by conventional fed-batch fermentation. A nutrient medium contained 0.5-2.5% corn steep solids (Roquette), 5-25 g/L sodium and potassium phosphate, a solution of 0.3-0.6 M ferrous sulfate, manganese chloride and calcium chloride, 0.5-4 g/L magnesium sulfate, and a solution of 0.01-3.7 g/L zinc sulfate, cuprous sulfate, boric acid and citric acid. An antifoam agent, Foamblast 882, of 2-4 mL/L was added to control foaming. 2-L fermentation was fed with 50% w/w glucose feed when initial glucose in batch was non-detectable. The glucose feed rate was ramped over several hours. The fermentation was controlled at 20% DO and temperature of either 30° C. or 37° C., and initiated at an initial agitation of 400 rpm. The pH was controlled at 7.2 using 50% v/v ammonium hydroxide. Fermentation parameters such as pH, temperature, airflow, DO % were monitored throughout the entire 2-3 day fermentation run. The culture broth was harvested at the end of run and centrifuged to obtain supernatant containing GTF. The supernatant was then stored frozen at −80° C.

Example 12

Production of Mutanase MUT3264 GI: 257153264 in *E. coli* BL21(DE3)

A gene encoding mutanase from *Paenibacillus humicus* NA1123 identified in GENBANK® as GI:257153264 (SEQ ID NO: 22) was synthesized by GenScript (GenScript USA Inc., Piscataway, NJ). The nucleotide sequence (SEQ ID NO: 20) encoding protein sequence (“MUT3264”; SEQ ID NO: 21) was subcloned into pET24a (Novagen; Merck KGaA, Darmstadt, Germany). The resulting plasmid was transformed into *E. coli* BL21(DE3) (Invitrogen) to generate the strain identified as SGZY6. The strain was grown at 37° C. with shaking at 220 rpm to $OD_{600}$ of ~0.7, then the temperature was lowered to 18° C. and IPTG was added to a final concentration of 0.4 mM. The culture was grown overnight before harvest by centrifugation at 4000 g. The cell pellet from 600 mL of culture was suspended in 22 mL 50 mM KPi buffer, pH 7.0. Cells were disrupted by French Cell Press (2 passages @ 15,000 psi (103.4 MPa)); cell debris was removed by centrifugation (SORVALL™ SS34 rotor, @13,000 rpm; Thermo Fisher Scientific, Inc., Waltham, MA) for 40 min. The supernatant was analyzed by SDS-PAGE to confirm the expression of the “mut3264” mutanase and the crude extract was used for activity assay. A control strain without the mutanase gene was created by transforming *E. coli* BL21(DE3) cells with the pET24a vector.

Example 13

Production of Mutanase MUT3264 GI: 257153264 in *B. subtilis* Strain BG6006 Strain SG1021-1

SG1021-1 is a *Bacillus subtilis* mutanase expression strain that expresses the mutanase from *Paenibacillus humicus* NA1123 isolated from fermented soy bean natto. For recombinant expression in *B. subtilis*, the native signal peptide was replaced with a *Bacillus* AprE signal peptide (GENBANK® Accession No. AFG28208; SEQ ID NO: 25). The polynucleotide encoding MUT3264 (SEQ ID NO: 23) was operably linked downstream of an AprE signal peptide (SEQ ID NO: 25) encoding *Bacillus* expressed MUT3264 provided as SEQ ID NO: 24. A C-terminal lysine was deleted to provide a stop codon prior to a sequence encoding a poly histidine tag.

The *B. subtilis* host BG6006 strain contains 9 protease deletions (amyE::xylRPxylAcomK-ermC, degUHy32, oppA, ΔspoIIE3501, ΔaprE, ΔnprE, Δepr, ΔispA, Δbpr, Δvpr, ΔwprA, Δmpr-ybfJ, ΔnprB). The wild type mut3264 (as found under GENBANK® GI: 257153264) has 1146 amino acids with the N terminal 33 amino acids deduced as the native signal peptide by the SignalP 4.0 program (Nordahl et al., (2011) *Nature Methods,* 8:785-786). The mature mut3264 without the native signal peptide was synthesized by GenScript and cloned into the NheI and HindIII sites of the replicative *Bacillus* expression pHYT vector under the aprE promoter and fused with the *B. subtilis* AprE signal peptide (SEQ ID NO: 25) on the vector. The construct was first transformed into *E. coli* DH10B and selected on LB with ampicillin (100 μg/mL) plates. The confirmed construct pDCQ921 was then transformed into *B. subtilis* BG6006 and selected on the LB plates with tetracycline (12.5 μg/mL). The resulting *B. subtilis* expression strain SG1021 was purified and a single colony isolate, SG1021-1, was used as the source of the mutanase mut3264. SG1021-1 strain was first grown in LB containing 10 μg/mL tetracycline, and then sub-cultured into GrantsII medium containing 12.5 μg/mL tetracycline and grown at 37° C. for 2-3 days. The cultures were spun at 15,000 g for 30 min at 4° C. and the supernatant filtered through a 0.22 μm filter. The filtered supernatant containing MUT3264 was aliquoted and frozen at −80° C.

Example 14

Production of Mutanase MUT3325 GI: 212533325

A gene encoding the *Penicillium marneffei* ATCC® 18224™ mutanase identified in GENBANK® as GI:212533325 was synthesized by GenScript (Piscataway, NJ). The nucleotide sequence (SEQ ID NO: 26) encoding protein sequence (MUT3325; SEQ ID NO: 27) was subcloned into plasmid pTrex3 (SEQ ID NO: 59) at SacII and AscI restriction sites, a vector designed to express the gene of interest in *Trichoderma reesei*, under control of CBHI promoter and terminator, with *Aspergillus niger* acetamidase for selection. The resulting plasmid was transformed into *T. reesei* by biolistic injection as described in the general method section, above. The detailed method of biolistic transformation is described in International PCT Patent Application Publication WO2009/126773 A1. A 1 $cm^2$ agar plug with spores from a stable clone TRM05-3 was used to inoculate the production media (described below). The culture was grown in the shake flasks for 4-5 days at 28° C. and 220 rpm. To harvest the secreted proteins, the cell mass was first removed by centrifugation at 4000 g for 10 min and the supernatant was filtered through 0.2 μM sterile filters. The expression of mutanase MUT3325 was confirmed by SDS-PAGE.

The production media component is listed below.

NREL-Trich Lactose Defined

| Formula | Amount | Units |
|---|---|---|
| ammonium sulfate | 5 | g |
| PIPPS | 33 | g |
| BD Bacto casamino acid | 9 | g |
| $KH_2PO_4$ | 4.5 | g |
| $CaCl_2 \cdot 2H_2O$ | 1.32 | g |
| $MgSO_4 \cdot 7H_2O$ | 1 | g |
| *T. reesei* trace elements | 2.5 | mL |
| NaOH pellet | 4.25 | g |
| Adjust pH to 5.5 with 50% NaOH | | |

-continued

| Formula | Amount | Units |
|---|---|---|
| Bring volume to | 920 | mL |
| Add to each aliquot: Foamblast | 5 | Drops |
| Autoclave, then add 20% lactose filter sterilized | 80 | mL |

*T. reesei* Trace Elements

| Formula | Amount | Units |
|---|---|---|
| citric acid•$H_2O$ | 191.41 | g |
| $FeSO_4$•$7H_2O$ | 200 | g |
| $ZnSO_4$•$7H_2O$ | 16 | g |
| $CuSO_4$•$5H_2O$ | 3.2 | g |
| $MnSO_4$•$H_2O$ | 1.4 | g |
| $H_3BO_3$ (boric acid) | 0.8 | g |
| Bring volume to | 1 | L |

Example 15

Production of MUT3325 by Fermentation

Fermentation seed culture was prepared by inoculating 0.5 L of minimal medium in a 2-L baffled flask with 1.0 mL frozen spore suspension of the MUT3325 expression strain TRM05-3 (Example 14) (The minimal medium was composed of 5 g/L ammonium sulfate, 4.5 g/L potassium phosphate monobasic, 1.0 g/L magnesium sulfate heptahydrate, 14.4 g/L citric acid anhydrous, 1 g/L calcium chloride dihydrate, 25 g/L glucose and trace elements including 0.4375 g/L citric acid, 0.5 g/L ferrous sulfate heptahydrate, 0.04 g/L zinc sulfate heptahydrate, 0.008 g/L cupric sulfate pentahydrate, 0.0035 g/L manganese sulfate monohydrate and 0.002 g/L boric acid. The pH was 5.5). The culture was grown at 32° C. and 170 rpm for 48 hours before transferred to 8 L of the production medium in a 14-L fermentor. The production medium was composed of 75 g/L glucose, 4.5 g/L potassium phosphate monobasic, 0.6 g/L calcium chloride dehydrate, 1.0 g/L magnesium sulfate heptahydrate, 7.0 g/L ammonium sulfate, 0.5 g/L citric acid anhydrous, 0.5 g/L ferrous sulfate heptahydrate, 0.04 g/L zinc sulfate heptahydrate, 0.00175 g/L cupric sulfate pentahydrate, 0.0035 g/L manganese sulfate monohydrate, 0.002 g/L boric acid and 0.3 mL/L foam blast 882.

The fermentation was first run with batch growth on glucose at 34° C., 500 rpm for 24 h. At the end of 24 h, the temperature was lowered to 28° C. and agitation speed was increased to 1000 rpm. The fermentor was then fed with a mixture of glucose and sophorose (62% w/w) at specific feed rate of 0.030 g glucose-sophorose solids/g biomass/hr. At the end of run, the biomass was removed by centrifugation and the supernatant containing the mutanase was concentrated about 10-fold by ultrafiltration using 10-kD Molecular Weight Cut-Off ultrafiltration cartridge (UFP-10-E-35; GEHealthcare, Little Chalfont, Buckinghamshire, UK). The concentrated protein was stored at −80° C.

Example 16

Production of Mutanase MUT6505 (GI: 259486505)

A polynucleotide encoding the *Aspergillus nidulans* FGSC A4 mutanase identified in GENBANK® as GI:259486505 was synthesized by GenScript (Piscataway, NJ). The nucleotide sequence (SEQ ID NO: 28) encoding protein sequence (MUT6505; SEQ ID NO: 29) was subcloned into plasmid pTrex3, a vector designed to express the gene of interest in *T. reesei*, under control of CBHI promoter and terminator, with *A. niger* acetamidase for selection. The resulting plasmid was transformed into *T. reesei* by biolistic injection. A 1 $cm^2$ agar plug with spores from a stable clone was used to inoculate the production media (ammonium sulfate 5 g/L, PIPPS 33 g/L; BD Bacto casamino acid 9 g/L, $KH_2PO_4$ 4.5 g/L, $CaCl_2 \cdot 2H_2O$ 1.32 g/L, $MgSO_4 \cdot 7H_2O$ 1 g/L, NaOH pellet 4.25 g/L, lactose 1.6 g/L, antifoam 204 0.01%, citric acid. $H_2O$ 0.48 g/L, $FeSO_4 \cdot 7H_2O$ 0.5 g/L, $ZnSO_4 \cdot 7H_2O$ 0.04 g/L, $CuSO_4 \cdot 5H_2O$ 0.008 g/L, $MnSO_4 \cdot H_2O$ 0.0036 g/L and boric acid 0.002 g/L at pH 5.5.). The culture was grown in the shake flasks for 4-5 days at 28° C. and 220 rpm. To harvest the secreted proteins, the cell mass was first removed by centrifugation at 4000 g for 10 min and the supernatant was filtered through 0.2 μM sterile filters. The expression of MUT6505 was confirmed by SDS-PAGE. The crude protein extract containing MUT6505 was stored at −80° C.

Example 17

Production of *H. tawa*, *T. konilangbra* and *T. reesei* Mutanases

The following describes the methods used to obtain the respective polynucleotide and amino acid sequences for mutanases from *Hypocrea tawa* (SEQ ID NOs: 53 and 54), *Trichoderma konilangbra* (SEQ ID NOs: 55 and 56), and *Trichoderma reesei* (SEQ ID NOs: 57 and 58).

Isolation of Genomic DNA

Fungal cultures of *Trichoderma reesei* 592, *Trichoderma konilangbra* and *Hypocrea tawa* were prepared (see EP2644187A1 and corresponding U.S. Patent Appl. Pub. No 2011-0223117A1 to Kim et al.) by adding 30 mL of sterile YEG broth to three 250-mL baffled Erlenmeyer shaking flasks in the biological hood. A 131-inch (~333 cm) square was cut and removed from each respective fungal culture plate using a sterile plastic loop and placed into the appropriate culture flask. The inoculated flasks were then placed into the 28° C. shaking incubator to grow overnight.

The *T. reesei, T. konilangbra*, and *H. tawa* cultures were removed from the shaking incubator and the contents of each flask were poured into separate sterile 50 mL Sarstedt tubes. The Sarstedt tubes were placed in a table-top centrifuge and spun at 4,500 rpm for 10 min to pellet the fungal mycelia. The supernatants were discarded and a large loopful of each mycelial sample was transferred to a separate tube containing lysing matrix (FASTDNA™). Genomic DNA was extracted from the harvested mycelia using the FASTDNA™ kit (Qbiogene, now MP Biomedicals Inc., Santa Ana, CA) according to the manufacturer's protocol for algae, fungi and yeast. The homogenization time was 25 seconds. The amount and quality of genomic DNA extracted was determined by gel electrophoresis.

Obtaining Alpha-Glucanase Polypeptides by PCR

A. *T. reesei*

Putative α-1,3 glucanase genes were identified in the *T. reesei* genome (JGI) by homology. PCR primers for *T. reesei* were designed based on the putative homolog DNA sequences. Degenerate PCR primers were designed for T *konilangbra* or *H. tawa* based on the putative *T. reesei* protein sequences and other published α-1,3 glucanase protein sequences.

*T. reesei* Specific PCR Primers:

```
SK592:
                                  (SEQ ID NO: 30)
5'-CACCATGTTTGGTCTTGTCCGC-3'

SK593:
                                  (SEQ ID NO: 31)
5'-TCAGCAGTACTGGCATGCTG-3'
```

The PCR conditions used to amplify the putative α-1,3 glucanase from genomic DNA extracted from *T. reesei* strain RL-P37 (U.S. Pat. No. 4,797,361A; NRRL-15709, Agricultural Research Service s, USDA, Peoria, Illinois) were as follows:

1. 94° C. for 2 minutes,
2. 94° C. tor 30 seconds,
3. 56° C. for 30 seconds,
4. 72° C. for 3 minutes,
5. return to step 2 for 24 cycles,
6. hold at 4° C.

Reaction samples contained 2 mL of *T. reesei* RL-P37 genomic DNA, 10 mL of the 10× buffer, 2 mL 10 mM dN TPs mixture, 1 mL primers SK592 and SK593 at 20 mM, 1 mL of the PfuUltra high fidelity DNA polymerase (Agilent Technologies, Santa Clara, CA) and 83 mL distilled water.

B. *T. konilangbra* and *H. tawa*

Initial PCR reactions used degenerate primers designed from protein alignments of several homologous sequences. A primary set of degenerate primers, designed to anneal near the 5' and 3' ends, were used in the first PCR reaction to amplify similar sequences to that of an α-1,3 glucanase.

Degenerate primers for initial cloning:

*H. tawa* and *T. konilangbra*:

```
MA1F:
                                  (SEQ ID NO: 32)
5'-GTNTTYTGYCAYTTYATGAT-3'

MA2F:
                                  (SEQ ID NO: 33)
5'-GTNTTYTGYACAYTTYATGATHGGNAT-3'

MA4F:
                                  (SEQ ID NO: 34)
5'-GAYTAYGAYGAYGAYATGCARCG-3'

MA5F:
                                  (SEQ ID NO: 35)
5'-GTRCAYTTRCAIGGICCIGGIGGRCARTANCC-3'

MA6R:
                                  (SEQ ID NO: 36)
5'-YTCICCIGGNAGNGGRCANCCRTT-3'

MA7R:
                                  (SEQ ID NO: 37)
5'-RCARTAYTGRCAIGCYGTYGGYGGRCARTA-3'
```

The products of these PCR reactions were then used in a nested PCR using primers designed to attach within the product of the initial PCR fragment, under the same amplification conditions Specific primers for initial cloning:

*T. konilangbra*:

```
TP1S:
                                  (SEQ ID NO: 38)
5'-CCCCCTGGCCAAGTATGTGT-3'

TP2A:
                                  (SEQ ID NO: 39)
5'-GTACGCAAAGTTGAGCTGCT-3'
```

-continued

```
TP3S:
                                  (SEQ ID NO: 40)
5'-AGCACATCGCTGATGGATAT-3'

TP3A:
                                  (SEQ ID NO: 41)
5'-AAGTATACGTTGCTTCCGGC-3'

TP4S:
                                  (SEQ ID NO: 42)
5'-CTGACGATCGGACTRCACGT-3'

TP4A:
                                  (SEQ ID NO: 43)
5'-CGTTGTCGACGTAGAGCTGT-3'
```

*H. tawa*:

```
HP2A:
                                  (SEQ ID NO: 44)
5'-ACGATCGGCAGAGTCATAGG-3'

HP3S:
                                  (SEQ ID NO: 45)
5'-ATCGGATTGCATGTCACGAC-3'

HP3A:
                                  (SEQ ID NO: 46)
5'-TACATCCAGACCGTCACCAG-3'

HP4S:
                                  (SEQ ID NO: 47)
5'-ACGTTTGCTCTTGCGGTATC-3'

HP4A:
                                  (SEQ ID NO: 48)
5'-TCATTATCCCAGGCCTAAAA-3'
```

Gel electrophoresis of the PCR products was used to determine whether fragments of expected size were amplified. Single nested PCR products of the expected size were purified using the QIAquick PCR purification kit (QIAGEN). In addition, expected size products were excised and extracted from agarose gels containing multiple product bands and purified using the QIAquick Gel Extraction kit (QIAGEN).

Transformation/Isolate Screening/Plasmid Extraction

PCR products were inserted into cloning vectors using the Invitrogen ZERO BLUNT® TOPO® PCR cloning kit, according to the manufacturer's specifications (Life Technologies Corporation, Carlsbad, CA). The vector was then transformed into ONE SHOT® TOP10 chemically competent E. co/i cells, according to the manufacturer's recommendation and then spread onto LB plates containing 50 ppm of Kanamycin. These plates were incubated in the 37° C. incubator overnight.

To select transformants that contained the vector and DNA insert, colonies were selected from the plate for crude plasmid extraction. 50 mL of DNA Extraction Solution (100 mM NaCl, 10 mM EDTA, 2 mM Tris pH 7) was added to clean 1.5 mL Eppendorf tubes. In the biological hood, 7-10 individual colonies of each TOPO® transformation clone were numbered, picked and resuspended in the extraction solution. In the chemical hood, 50 mL of Phenol: Chloroform: Isoamyl alcohol was added to each sample and vortexed thoroughly. Tubes were microcentrifuged at maximum speed for 5 minutes, after which 20 mL of the top aqueous layer was removed and placed into a clean PCR tubes. 1 mL of RNase (2 mg/m L) was then added, and samples were mixed and incubated at 37° C. tor 30 minutes.

The entire sample volume was then run on a gel to determine the presence of the insert in the TOPO® vector based on difference in size to an empty vector. Once the transformant colonies had been identified, those clones was scraped from the plate and used to inoculate separate 15-mL tubes containing 5 mL of LB/Kanamycin medium (0.0001%). The cultures were placed in the 37° C. shaking incubator overnight.

Samples were removed from the incubator and centrifuged for 6 min at 6,000 rpm using the Sorval centrifuge. The QIAprep Spin Miniprep kit (QIAGEN) and protocol were used to isolate the plasmid DNA, which was then digested to confirm the presence of the insert. The restriction enzyme used was dependent on the sites present in and around the insert sequence. Gel electrophoresis was used to determine fragment size. Appropriate DNA samples were submitted for sequencing (Sequetech, Mountain View, CA).

Cloning the 3' and 5' Ends

All DNA fragments were sequenced. Sequences were aligned and compared to determine nucleotide and amino acid identities using ALIGNX® and CONTIGEXPRESS® (Vector NTI® suite, Life Sciences Corp., Carlsbad, CA). Specific primers were designed to amplify the 3' and 5' portions of each incomplete fragment from *H. tawa* and *T. konilangbra* by extending outward from the known sequence. At least three specific primers each nested within the amplified product of the previous primer set were designed for each template. Amplification of the 5' and 3' sequences was performed using the nested primer sets with the LA PCR In vitro Cloning Kit (Takara Bio Inc., Otsu, Japan)

Fresh genomic DNA was prepared for this amplification. Cultures of *T. konilangbra* and *H. tawa* were prepared by inoculating 30 mL of YEG broth with a 1 square inch section of the appropriate sporulated fungal plate culture in 250-mL baffled Erlenmeyer flasks. The flasks were incubated in the 28° C. shaking incubator overnight. The cultures were harvested by centrifugation in 50-mL Sarstedt tubes at 4,500 rpm for 10 minutes. The supernatant was discarded and the mycelia were stored overnight in a −80° C. freezer. The frozen mycelia were then placed into a coffee grinder along with a few pieces of dry ice. The grinder was run until the entire mixture had a powder like consistency. The powder was then air dried and transferred to a sterile 50-mL Sarstedt tube containing 10 mL of EASY-DNA™ Kit Solution A (Life Sciences Corp.) and the manufacturer's protocol was followed. The concentration of the genomic DNA collected from the extraction was measured using the NanoDrop spectrophotometer. The LA PCR In vitro Cloning Kit cassettes were chosen based on the absence of a particular restriction site within the known DNA sequences, and the manufacturer's instructions were followed. For first PCR run, 1 mL of the ligation DNA sample was diluted in 33.5 mL of sterilized distilled water. Different primers were used depending on the sample and the end fragment desired. For the 5' ends, primers HP4A and TP3A were used for *H. tawa* and *T. konilangbra* respectively, while for the 3' ends primers HP4S and TP3S were used for *H. tawa* and *T. konilangbra*. The PCR mixture was prepared by adding 34.5 mL diluted ligation DNA solution, 5 mL of 10×LA Buffer II ($Mg^{2+}$), 8 mL dNTPs mixture, 1 mL cassette primer I, 1 mL specific primer I (depending on sample and end fragment), and 0.5 mL Takara LA Taq polymerase. The PCR tubes were then placed in a thermocycler following the listed protocol:

1. 94° C. for 10 min,
2. 94° C. for 30 s,
3. 55° C. for 30 s,
4. 72° C. for 4 min, return to step 2 30 times,
5. Hold at 4° C.

A second PCR reaction was prepared by taking 1 mL of the first PCR reaction and diluting the sample in sterilized distilled water to a dilution factor of 1:10,000. A second set of primers nested within the first amplified region were used to amplify the fragment isolated in the first PCR reaction. Primers HP3A and TP4A were used to amplify toward the 5' end of *H. tawa* and *T. konilangbra* respectively, while primers HP3S and TP4S were used to amplify toward the 3' end. The diluted DNA was added to the PCR reaction containing 33.5 mL distilled sterilized water, 5 mL 10×LA Buffer II ($Mg^{2}$'), 8 mL dNTPs mixture, 1 mL of cassette primer 2, 1 mL of specific primer 2 (dependent on sample and fragment, end), 0.5 mL Takara LA Taq, and mixed thoroughly before the PCR run. The PCR protocol was the same as the first reaction, without the initial 94° C. for 10 minutes. After the reaction was complete, the sample was run by gel electrophoresis to determine size and number of fragments isolated. If a single band was present, the sample was purified and sent for sequencing. If no fragment was isolated, a third PCR reaction was performed using the previous protocol for a nested PCR reaction. After running the amplified fragments by gel electrophoresis, the brightest band was excised, purified, and sent for sequencing.

Analysis of Sequence Alignments

Sequences were obtained and analyzed using the Vector NTI suite, including ALIGNX®, and CONTIGEXPRESS®. Each respective end fragment sequence was aligned to the previously obtained fragments of *H. tawa* and *T. konilangbra* to obtain the entire gene sequence. Nucleotide alignments with *T. harzianum* and *T. reesei* sequences revealed the translation start and stop points of the gene of interest in both *H. tawa* and *T. konlangbra*. After the entire gene sequence was identified, specific primers were designed to amplify the entire gene from the genomic DNA. Primers were designed as described earlier, with the exception of adding CACC nucleotide sequence before the translational starting point, for GATEWAY® cloning (Life Sciences Corp.).

Primers for Final Cloning:

*T. konilangbra*:

```
T1FS:
                                    (SEQ ID NO: 49)
caccatgctaggcattctccg

T1FA:
                                    (SEQ ID NO: 50)
tcagcagtattggcatgccg
```

*H. tawa*:

```
H1FS:
                                    (SEQ ID NO: 51)
CACCATGTTGGGCGTTTTTCG

H1FA:
                                    (SEQ ID NO: 52)
CTAGCAGTATTGRCATGCCG
```

The PCR protocol was followed as previously described with the exception of altering the annealing temperature to 55° C. After a single band was isolated and viewed through gel electrophoresis, the amplified fragment was purified as described earlier and used in the pENTR/D TOPO® (Life Sciences Corp.) transformation, according to the manufacturer's instructions. Chemically competent *E. coli* cells were then transformed as previously described, and transferred to LB plates containing 50 ppm of kanamycin. Following 37° C. incubation overnight, transformants containing the plasmid and insert were selected after crude DNA extraction and plasmid size analysis, as previously described. The selected transformants were scraped from the plate and used to inoculate a fresh 15-mL tube containing 5 mL of LB/Kanamycin medium (0.0001%). Cultures were placed in the 37° C. shaking incubator overnight. Cells were harvested by centrifugation and the plasmid DNA extracted as previously described. Plasmid DNA was digested to confirm the presence of the insert sequence, and then submitted for sequencing. The LR Clonase reaction (Gateway Cloning, Invitrogen (Life Sciences Corp.)) was used, according to manufacturer's instructions, to directionally transfer the insert from the pENTR™/D vector into the destination vector. The destination vector is designed for expression of a gene of interest, in *T. reesei*, under control of the CBH1 promoter and terminator, with *A. niger* acetamidase for selection.

Biolistic Transformation (See General Methods)

Expression of α-1,3 Glucanases by *T. reesei* Transformants

A 1 $cm^2$ agar plug was used to inoculate Proflo seed media. Cultures were incubated at 28° C., with 200 rpm Modified amdS Biolistic agar (MABA) per liter shaking. On the second day, a 10% transfer was aseptically made into Production media. The cultures were incubated at 28° C., with 200 rpm shaking. On the third day, cultures were harvested by centrifugation. Supernatants were sterile filtered (0.2 mm polyethersulfone filter; PES) and stored at 4° C. Analysis by SDS-PAGE identified clones expressing the respective alpha-glucanase genes. The growth conditions for the *T. reesei* transformants followed those used in Example 14.

Example 18

Production of Soluble Oligosaccharides Using Glucosyltransferase Gtf-J (Gi:47527) with Simultaneous or Sequential Addition of Mutanase Reactions (10 mL total volume) were run with 100 g/L sucrose in 50 mM phosphate buffer (pH 6.8) at 35° C., with mixing supplied by a magnetic stir bar. To each reaction was added 0.3% (v/v) concentrated *E. coli* crude protein extract containing *Streptococcus salivarius* GTF-J (GI: 47527, GTF7527; Example 3). *T. reesei* crude protein extract containing either *T. konilangbra* mutanase or *T. reesei* 592 mutanase (Example 17) was added at 10% (v/v) of final reaction volume to a reaction either simultaneously with addition of crude protein extract containing GTF-J, or 24 h after addition of crude protein extract containing GTF-J. A control reaction was run with no added mutanase. Aliquots were withdrawn at 4 h and either 22 h or 24 h and quenched by heating at 60° C. for 30 min. Insoluble material was removed from heat-treated samples by centrifugation. The resulting supernatant was analyzed by HPLC to determine the concentration of sucrose, glucose, fructose, leucrose and oligosaccharides (Tables 3 and 4); DP3-DP7 yield was calculated based on sucrose conversion.

TABLE 3

Monosaccharide, disaccharide and oligosaccharide concentrations in reactions containing *Streptococcus salivarius* GTF-J and either *T. reesei* 592 or *T. konilangbra* mutanase added with GTF-J at start of reaction.

| Rxn # | mutanase protein crude extract | Time (h) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | DP3-DP7 yield (%) | Leuc./Fruc. |
|---|---|---|---|---|---|---|---|---|---|---|---|---|---|---|---|
| 1 | none | 4 | 70.0 | 5.8 | 4.9 | 14.4 | 0.1 | 0.3 | 0.0 | 0.6 | 1.1 | 2.1 | 2.1 | 15 | 0.40 |
| | | 22 | 8.3 | 26.3 | 7.2 | 38.2 | 0.1 | 0.1 | 0.5 | 2.1 | 5.4 | 5.1 | 8.2 | 19 | 0.69 |
| 2 | *T. reesei* | 4 | 33.8 | 9.7 | 23.1 | 32.9 | 1.1 | 1.1 | 1.6 | 0.6 | 5.0 | 5.3 | 9.4 | 30 | 0.29 |
| | 592 | 22 | 14.0 | 17.8 | 23.7 | 41.7 | 0.3 | 0.3 | 0.3 | 1.7 | 7.6 | 8.6 | 10.2 | 25 | 0.43 |
| | mutanase | | | | | | | | | | | | | | |
| 3 | *T. konilangbra* | 4 | 61.8 | 8.0 | 5.7 | 17.6 | 0.8 | 1.2 | 1.8 | 2.4 | 1.4 | 2.5 | 7.6 | 42 | 0.45 |
| | mutanase | 22 | 9.6 | 27.1 | 4.9 | 36.1 | 0.3 | 0.3 | 0.8 | 2.4 | 9.5 | 3.7 | 13.3 | 31 | 0.75 |

TABLE 4

Monosaccharide, disaccharide and oligosaccharide concentrations in reactions containing *Streptococcus salivarius* GTF-J and either *T. reesei* 592 or *T. konilangbra* mutanase added 24 h after GTF-J addition.

| Rxn # | mutanase protein crude extract | Time (h) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | DP3-DP7 selectivity (%) | Leuc./Fruc. |
|---|---|---|---|---|---|---|---|---|---|---|---|---|---|---|---|
| 1 | none | 4 | 8.6 | 26.0 | 7.0 | 38.3 | 0.3 | 0.9 | 0.0 | 1.9 | 2.8 | 4.0 | 5.9 | 14 | 0.68 |
| | | 24 | 9.4 | 26.4 | 6.1 | 38.1 | 0.0 | 0.4 | 0.0 | 1.4 | 2.5 | 5.0 | 4.3 | 10 | 0.69 |
| 2 | *T. reesei* | 4 | 9.8 | 27.4 | 6.0 | 37.7 | 0.4 | 1.7 | 0.0 | 4.8 | 2.6 | 2.8 | 9.5 | 22 | 0.73 |
| | 592 | 24 | 8.9 | 26.3 | 0.0 | 33.1 | 0.1 | 1.1 | 0.0 | 2.6 | 5.5 | 2.0 | 9.3 | 22 | 0.79 |
| | mutanase | | | | | | | | | | | | | | |
| 3 | *T. konilangbra* | 4 | 9.8 | 27.6 | 5.7 | 37.4 | 0.4 | 1.5 | 0.0 | 1.5 | 2.5 | 4.9 | 5.9 | 14 | 0.74 |
| | mutanase | 24 | 9.0 | 26.5 | 0.0 | 34.4 | 0.0 | 0.5 | 0.5 | 2.2 | 6.4 | 8.1 | 9.6 | 22 | 0.77 |

Example 19

Production of Soluble Oligosaccharides Using Glucosyltransferase GTF-J (Gi:47527) with Simultaneous or Sequential Addition of Mutanase Reactions (10 mL total volume) were run with 100 g/L sucrose in 50 mM phosphate buffer (pH 6.8) at 30° C., with mixing supplied by a magnetic stir bar. To each reaction was added 0.3% (v/v) concentrated *E. coli* crude protein extract containing *Streptococcus salivarius* GTF-J (GI:47527, GTF7527; Example 3). *B. subtilis* crude protein extract containing *Paenibacillus humicus* mutanase (GI: 257153264, mut3264; Example 12) was added at 10% (v/v) of final reaction volume to a reaction either simultaneously with addition of crude protein extract containing GTF-J, or 24 h after addition of crude protein extract containing GTF-J. A control reaction was run with no added mutanase. Aliquots were withdrawn at either 4 h or 5 h and either 20 h or 21 h and quenched by heating at 60° C. for 30 min. Insoluble material was removed from heat-treated samples by centrifugation. The resulting supernatant was analyzed by HPLC to determine the concentration of sucrose, glucose, fructose, leucrose and oligosaccharides (Tables 5 and 46; DP3-DP7 yield was calculated based on sucrose conversion.

Example 20

Production of Soluble Oligosaccharides Using Combination of Glucosyltransferase Gtf-J (Gi:47527) Enzyme and Mutanases Reaction 1 comprised sucrose (100 g/L), *E. coli* concentrated crude protein extract (0.3% v/v) containing GTF-J from *S. salivarius* (GI:47527, GTF7527; Example 3) in 50 mM phosphate buffer, pH 6.0. Reactions 2 and 4 comprised sucrose (100 g/L), *E. coli* concentrated crude protein extract (0.3% v/v) containing GTF-J from *S. salivarius* (Example 3) and either a *T. reesei* crude protein extract (10% v/v) comprising a mutanase from *Penicillium marneffei* ATCC® 18224 (GI:212533325, mut3325; Example 14) or an *E. coli* crude protein extract (10% v/v) comprising a mutanase from *Paenibacillus humicus* (GI:257153264, mut3264; Example 12) in 50 mM phosphate buffer, pH 6.0. Control reactions 3 and 5 used either a *T. reesei* crude protein extract (10% v/v) or an *E. coli* crude protein extract (10% v/v), respectively, that did not contain mutanase. The total volume for each reaction was 10 mL and all reactions were performed at 40° C. with shaking at 125 rpm. Aliquots were withdrawn at 5 h and 24 h and quenched by heating at 95° C. for 5 min. Insoluble material was removed by centrifugation and filtration. The soluble products were analyzed by HPLC to determine the concentration of sucrose, glucose, fructose, leucrose and oligosaccharides (Table 7). The soluble products from each reaction at 24 h were also analyzed by $^1H$ NMR spectroscopy to determine the anomeric linkages of the oligosaccharides (Table 8).

TABLE 5

Monosaccharide, disaccharide and oligosaccharide concentrations in reactions containing *Streptococcus salivarius* GTF-J (GI 47527) and *Paenibacillus humicus* mutanase (GI: 257153264, mut3264) at start of reaction.

| Rxn # | Protein crude extract | Time (h) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) | Leuc/ Fruc |
|---|---|---|---|---|---|---|---|---|---|---|---|---|---|---|---|
| 1 | none | 5 | 55.3 | 10.4 | 5.1 | 19.1 | 0.2 | 0.5 | 0.0 | 1.3 | 1.5 | 2.6 | 3.5 | 16.5 | 0.54 |
| | | 21 | 6.0 | 27.6 | 6.6 | 38.5 | 0.5 | 1.2 | 0.0 | 2.3 | 3.2 | 4.3 | 7.2 | 16.2 | 0.72 |
| 2 | *Bacillus* | 5 | 51.1 | 10.6 | 8.1 | 22.8 | 0.2 | 0.7 | 0.0 | 1.6 | 2.6 | 3.5 | 5.2 | 22.4 | 0.46 |
| | extract without mutanase | 21 | 7.9 | 27.3 | 6.2 | 40.2 | 0.5 | 1.5 | 0.0 | 3.1 | 3.9 | 4.7 | 8.9 | 20.4 | 0.68 |
| 3 | *Bacillus* | 5 | 40.1 | 12.3 | 7.4 | 28.7 | 0.1 | 1.7 | 0.0 | 5.5 | 3.6 | 3.3 | 11.0 | 38.7 | 0.43 |
| | extract with mut3264 | 21 | 8.7 | 27.0 | 8.5 | 39.8 | 0.1 | 0.2 | 0.6 | 9.9 | 6.8 | 5.9 | 17.7 | 40.9 | 0.68 |

TABLE 6

Monosaccharide, disaccharide and oligosaccharide concentrations in reactions containing *Streptococcus salivarius* GTF-J (GI 47527) and *Paenibacillus humicus* mutanase (GI: 257153264, mut3264), with mutanase added 24 h after start of reaction with GTF-J only.

| Rxn # | Protein crude extract | Time after mutanase addition (h) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) | Leuc/ Fruc |
|---|---|---|---|---|---|---|---|---|---|---|---|---|---|---|---|
| 1 | none | 4 | 8.6 | 27.7 | 8.8 | 41.0 | 0.5 | 1.3 | 0.0 | 2.5 | 3.4 | 4.6 | 7.7 | 17.8 | 0.68 |
| | | 20 | 9.5 | 30.0 | 5.0 | 40.2 | 0.8 | 1.6 | 0.0 | 2.3 | 3.5 | 4.9 | 8.2 | 19.1 | 0.75 |
| 2 | *Bacillus* | 4 | 10.3 | 24.6 | 14.2 | 38.1 | 0.1 | 0.2 | 0.3 | 3.4 | 3.7 | 5.3 | 7.7 | 18.1 | 0.65 |
| | extract, with mut3264 | 20 | 12.3 | 29.2 | 9.6 | 37.3 | 0.2 | 0.2 | 0.4 | 3.6 | 6.4 | 6.8 | 10.8 | 26.0 | 0.78 |

TABLE 7

| Rxn # | Protein crude extract | Time (h) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) | Leuc/ Fruc |
|---|---|---|---|---|---|---|---|---|---|---|---|---|---|---|---|
| Monosaccharide, disaccharide and oligosaccharide concentrations measured by HPLC. | | | | | | | | | | | | | | | |
| 1 | NA | 5 | 50.5 | 8.7 | 6.9 | 20.6 | 0.0 | 0.0 | 0.3 | 0.7 | 1.2 | 2.4 | 2.2 | 8.9 | 0.42 |
| | | 24 | 0.6 | 25.2 | 8.9 | 38.2 | 0.0 | 0.2 | 0.8 | 1.9 | 2.7 | 3.4 | 5.7 | 11.7 | 0.66 |
| 2 | *T. reesei* extract with mut3225 | 5 | 2.9 | 11.6 | 3.2 | 45.1 | 0.1 | 4.3 | 10.2 | 11.6 | 4.8 | 0.6 | 31.0 | 65.6 | 0.26 |
| | | 24 | 3.5 | 13.5 | 0.0 | 44.3 | 0.0 | 0.0 | 7.2 | 12.3 | 10.0 | 4.2 | 29.5 | 62.8 | 0.31 |
| 3 | *T. reesei* extract, no mutanase | 5 | 58.4 | 10.1 | 7.3 | 18.1 | 0.0 | 0.0 | 0.3 | 1.0 | 1.5 | 2.3 | 2.9 | 14.1 | 0.56 |
| | | 24 | 21.2 | 21.6 | 6.5 | 29.1 | 0.0 | 0.0 | 0.6 | 2.1 | 3.1 | 3.8 | 5.8 | 15.0 | 0.74 |
| 4 | *E. coli* extract with mut3264 | 5 | 7.5 | 11.6 | 7.2 | 44.0 | 0.0 | 0.0 | 0.6 | 19.3 | 10.3 | 5.4 | 30.2 | 66.7 | 0.26 |
| | | 24 | 6.3 | 13.1 | 5.0 | 44.9 | 0.0 | 0.0 | 0.0 | 17.4 | 10.4 | 6.8 | 27.8 | 60.8 | 0.29 |
| 5 | *E. coli* extract, no mutanase | 5 | 49.9 | 9.2 | 6.7 | 21.3 | 0.0 | 0.0 | 0.3 | 0.7 | 1.2 | 2.4 | 2.1 | 8.7 | 0.43 |
| | | 24 | 22.0 | 19.5 | 6.2 | 32.0 | 0.0 | 0.0 | 0.6 | 1.3 | 1.9 | 2.8 | 3.8 | 10.0 | 0.61 |

TABLE 8

| Rxn # | Protein Crude Extract | % α-(1, 4) | % α-(1, 3) | % α-(1, 3, 6) | % α-(1, 2, 6) | % α-(1, 2) | % α-(1, 6) |
|---|---|---|---|---|---|---|---|
| Anomeric linkage analysis of soluble oligosaccharides by $^1$H NMR spectroscopy. | | | | | | | |
| 1 | NA | 14.2 | 47.5 | 5.8 | 0.0 | 0.0 | 32.6 |
| 2 | *T. reesei* extract, mut3325 | 2.5 | 93.4 | 0.7 | 0.0 | 0.0 | 3.4 |
| 3 | *T. reesei* extract, no mutanase | 13.8 | 45.8 | 7.8 | 0.0 | 0.0 | 32.5 |
| 4 | *E. coli* extract, mut3264 | 1.4 | 88.3 | 1.8 | 0.0 | 0.0 | 8.5 |
| 5 | *E. coli* extract, no mutanase | 14.0 | 47.7 | 7.2 | 0.0 | 0.0 | 31.1 |

More sucrose was consumed in the first 5 hr of reaction when mutanase was present. Crude extracts from *T. reesei* and *E. coli* strains that don't express mutanase didn't have the synergistic effect on sucrose consumption rate. The leucrose to fructose ratios were significantly lower in the presence of mutanases. The yield of soluble oligosaccharides significantly increased in the presence of mutanase. The percentage of α-(1, 3) linkages in the soluble oligosaccharides was substantially increased by the presence of mutanase.

Example 21

Production of Soluble Oligosaccharides by GTF-L and Mutanases

Reaction 1 comprised sucrose (100 g/L) and an *E. coli* protein crude extract (10% v/v) containing GTF-L from *Streptococcus salivarius* (GI:662379, GTF2379; Example 5) in 50 mM phosphate buffer, pH 6.0. Reactions 2 and 4 comprised sucrose (100 g/L), *E. coli* protein crude extract (10% v/v) containing GTF-L from *Streptococcus salivarius* (Example 5) and either a *T. reesei* crude protein extract (10%, v/v) containing *H. tawa* mutanase (Example 17) or an *E. coli* protein crude extract (10%, v/v) containing *Paenibacillus humicus* (GI:257153264, mut3264; Example 12) in 50 mM phosphate buffer, pH 6.0. Control reactions 3 and 5 used either a *T. reesei* protein crude extract (10% v/v) or an *E. coli* protein crude extract (10% v/v), respectively, that did not contain mutanase. The total volume for each reaction was 10 mL and all reactions were performed at 40° C. with shaking at 125 rpm. Aliquots were withdrawn at 5 h and 24 h and reactions were quenched by heating at 95° C. for 5 min. The insoluble materials were removed by centrifugation and filtration. The soluble product mixture was analyzed by HPLC to determine the concentration of sucrose, glucose, fructose, leucrose and oligosaccharides (Table 9). The soluble product from each reaction at 24 h was also analyzed by $^1$H NMR spectroscopy to determine the linkages present in the oligosaccharides (Table 10).

TABLE 9

| Rxn # | Protein crude extract | Time (hr) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) | Leuc/ Fruc |
|---|---|---|---|---|---|---|---|---|---|---|---|---|---|---|---|
| Monosaccharide, disaccharide and oligosaccharide concentrations measured by HPLC. | | | | | | | | | | | | | | | |
| 1 | NA | 5 | 40.3 | 12.9 | 8.1 | 19.9 | 0.3 | 0.5 | 0.8 | 1.2 | 1.5 | 3.6 | 4.3 | 14.9 | 0.65 |
| | | 24 | 5.2 | 27.8 | 8.6 | 34.5 | 1.8 | 2.4 | 3.0 | 3.3 | 3.7 | 6.7 | 14.1 | 30.6 | 0.81 |
| 2 | *T. reesei* extract, H. tawa mutanase | 5 | 28.4 | 17.8 | 25.8 | 44.2 | 0.2 | 0.7 | 1.4 | 2.4 | 6.2 | 8.0 | 11.0 | 31.3 | 0.40 |
| | | 24 | 8.4 | 19.4 | 20.8 | 40.6 | 0.3 | 0.8 | 1.6 | 2.3 | 4.4 | 9.7 | 9.3 | 20.8 | 0.48 |

TABLE 9-continued

Monosaccharide, disaccharide and oligosaccharide concentrations measured by HPLC.

| Rxn # | Protein crude extract | Time (hr) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) | Leuc/ Fruc |
|---|---|---|---|---|---|---|---|---|---|---|---|---|---|---|---|
| 3 | *T. reesei* extract, no mutanase | 5 | 41.9 | 13.3 | 8.5 | 20.7 | 0.3 | 0.6 | 0.9 | 1.3 | 1.6 | 3.8 | 4.6 | 16.2 | 0.64 |
| | | 24 | 5.1 | 28.4 | 8.1 | 34.5 | 1.8 | 2.5 | 2.9 | 3.3 | 3.8 | 7.2 | 14.3 | 30.9 | 0.82 |
| 4 | *E. coli* extract, mut3264 | 5 | 28.4 | 16.7 | 10.6 | 42.6 | 0.7 | 1.2 | 2.4 | 13.2 | 6.9 | 9.0 | 24.3 | 69.6 | 0.39 |
| | | 24 | 3.3 | 19.0 | 8.7 | 40.4 | 0.3 | 1.0 | 2.0 | 6.9 | 6.9 | 13.2 | 17.1 | 36.3 | 0.47 |
| 5 | *E. coli* extract, no mutanase | 5 | 48.1 | 17.1 | 10.4 | 26.2 | 0.00 | 3.5 | 3.5 | 5.8 | 4.7 | 6.3 | 17.5 | 69.2 | 0.65 |
| | | 24 | 5.1 | 28.2 | 8.7 | 34.4 | 1.9 | 2.6 | 3.2 | 3.5 | 3.9 | 6.9 | 15.0 | 32.6 | 0.82 |

TABLE 10

Anomeric linkage analysis of soluble oligosaccharides by $^1$H NMR spectroscopy.

| Rxn # | Protein Crude Extract | % α-(1, 4) | % α-(1, 3) | % α-(1, 3, 6) | % α-(1, 2, 6) | % α-(1, 2) | % α-(1, 6) |
|---|---|---|---|---|---|---|---|
| 1 | NA | 9.7 | 14.3 | 7.2 | 0.0 | 0.0 | 68.8 |
| 2 | *T. reesei* extract, H. tawa mutanase | 12.3 | 23.2 | 5.3 | 0.0 | 0.0 | 59.3 |
| 3 | *T. reesei* extract, no mutanase | 10.2 | 13.3 | 7.4 | 0.0 | 0.0 | 69.1 |
| 4 | *E. coli* extract, mut3264 | 6.3 | 56.4 | 3.1 | 0.0 | 0.0 | 34.3 |
| 5 | *E. coli* extract, no mutanase | 10.0 | 13.8 | 7.5 | 0.0 | 0.0 | 68.8 |

More sucrose was consumed in the first 5 h when mutanase was present. Crude extracts from *T. reesei* and *E. coli* strains that don't express mutanase don't have the synergistic effect on sucrose consumption rate. Less leucrose was produced in the presence of mutanase after 24 h when sucrose consumption was near completion. The leucrose to fructose ratios were significantly lower in the presence of mutanases. The amount of soluble oligosaccharides of DP3 to DP7 significantly increased in the presence of mut3264. More glucose was produced in the reaction with *H. tawa* mutanase than in other reactions. The percentage of α-(1,3) linkages in the soluble oligosaccharides was substantially increased by the presence of mutanase.

Example 22

Production of Soluble Oligosaccharides by GTF-B and Mutanases

Reaction 1 comprised sucrose (100 g/L) and *E. coli* protein crude extract (10% v/v) containing GTF-B from *Streptococcus mutans* NN2025 (GI:290580544, GTF0544; Example 6) in 50 mM phosphate buffer, pH 6.0. Reactions 2 and 4 below comprised sucrose (100 g/L), *E. coli* protein crude extract (10% v/v) containing GTF-B from *Streptococcus mutans* NN2025 (GI:290580544, GTF0544; Example 6) and either a *T. reesei* protein crude extract (10%, v/v) containing *H. tawa* mutanase (Example 17) or an *E. coli* protein crude extract (10%, v/v) containing *Paenibacillus humicus* mutanase (GI:257153264, mut3264; Example 12) in 50 mM phosphate buffer, pH 6.0. Control reactions 3 and 5 used either a *T. reesei* crude protein extract (10% v/v) or an *E. coli* crude protein extract (10% v/v), respectively, that did not contain mutanase. The total volume for each reaction was 10 mL and all reactions were performed at 40° C. with shaking at 125 rpm. Aliquots were withdrawn at 5 h and 24 h and reactions were quenched by heating aliquot samples at 95° C. for 5 min. The insoluble materials were removed by centrifugation and filtration, and the resulting filtrate was analyzed by HPLC to determine the concentration of sucrose, glucose, fructose, leucrose and oligosaccharides (Table 11). The soluble product from each reaction at 24 h was also analyzed by $^1$H NMR spectroscopy to determine the linkage of the oligosaccharides (Table 12).

TABLE 11

Monosaccharide, disaccharide and oligosaccharide concentrations measured by HPLC.

| Rxn # | Protein crude extract | Time (hr) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) | Leuc/ Fruc |
|---|---|---|---|---|---|---|---|---|---|---|---|---|---|---|---|
| 1 | NA | 5 | 77.1 | 3.1 | 2.9 | 14.2 | 0.0 | 0.3 | 0.5 | 0.5 | 0.3 | 0.6 | 1.5 | 13.9 | 0.22 |
| | | 24 | 28.7 | 14.3 | 2.0 | 31.1 | 1.9 | 2.5 | 2.6 | 1.9 | 1.0 | 1.7 | 9.8 | 28.4 | 0.46 |
| 2 | *T. reesei* extract, H. tawa mutanase | 5 | 69.5 | 3.3 | 10.4 | 22.0 | 0.0 | 0.3 | 0.8 | 0.8 | 2.0 | 1.8 | 3.9 | 26.3 | 0.15 |
| | | 24 | 11.6 | 11.5 | 13.1 | 40.4 | 1.1 | 2.3 | 3.0 | 2.2 | 2.4 | 4.3 | 10.9 | 25.5 | 0.29 |
| 3 | *T. reesei* extract, no mutanase | 5 | 74.6 | 3.1 | 3.0 | 14.1 | 0.0 | 0.3 | 0.5 | 0.5 | 0.3 | 0.7 | 1.6 | 12.8 | 0.22 |
| | | 24 | 30.4 | 14.6 | 3.1 | 29.8 | 2.0 | 2.7 | 2.8 | 2.4 | 1.9 | 2.3 | 11.8 | 35.0 | 0.49 |

TABLE 11-continued

| Monosaccharide, disaccharide and oligosaccharide concentrations measured by HPLC. | | | | | | | | | | | | | | | |
|---|---|---|---|---|---|---|---|---|---|---|---|---|---|---|---|
| Rxn # | Protein crude extract | Time (hr) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) | Leuc/ Fruc |
| 4 | *E. coli* extract, mut3264 | 5 | 59.4 | 3.2 | 3.0 | 21.8 | 0.2 | 1.0 | 2.0 | 5.2 | 2.5 | 2.6 | 10.8 | 54.6 | 0.15 |
| | | 24 | 5.7 | 11.2 | 1.5 | 43.6 | 2.4 | 5.1 | 5.9 | 6.0 | 4.3 | 5.2 | 23.7 | 51.8 | 0.26 |
| 5 | *E. coli* extract, no mutanase | 5 | 32.3 | 10.9 | 3.5 | 29.8 | 1.1 | 1.5 | 1.4 | 0.9 | 0.5 | 1.0 | 5.4 | 16.5 | 0.36 |
| | | 24 | 0.2 | 19.9 | 1.7 | 38.2 | 2.6 | 2.9 | 2.5 | 1.6 | 0.6 | 1.9 | 10.3 | 21.3 | 0.52 |

TABLE 12

| Linkage analysis of soluble oligosaccharides in each reaction by $^1$H NMR spectroscopy. | | | | | | | |
|---|---|---|---|---|---|---|---|
| Rxn # | Protein Crude Extract | % α-(1, 4) | % α-(1, 3) | % α-(1, 3, 6) | % α-(1, 2, 6) | % α-(1, 2) | % α-(1, 6) |
| 1 | NA | 6.3 | 15.4 | 3.0 | 0.0 | 0.0 | 75.3 |
| 2 | *T. reesei* extract, H. tawa mutanase | 3.5 | 15.9 | 5.6 | 0.0 | 0.0 | 75.1 |
| 3 | *T. reesei* extract, no mutanase | 6.4 | 17.8 | 3.3 | 0.0 | 0.0 | 72.5 |
| 4 | *E. coli* extract, mut3264 | 2.1 | 31.9 | 3.4 | 0.0 | 0.0 | 62.7 |
| 5 | *E. coli* extract, no mutanase | 4.8 | 9.4 | 2.7 | 0.0 | 0.0 | 83.1 |

More sucrose was consumed in the first 5 hr when mutanase was present. Crude protein extracts from *T. reesei* that did not express mutanase did not have the synergistic effect on sucrose consumption rate. More oligosaccharides of DP3-DP7 were produced in the presence of mut3264, but not in the presence of *H. tawa* mutanase or the two protein extracts without mutanase. Less leucrose was produced in the presence of mutanase after 24 h when sucrose consumption was near completion. The leucrose to fructose ratios were significantly lower in the presence of mutanases. High concentration of glucose was produced in the presence of the *H. tawa* mutanase. The percentage of α-(1,3) linkages in the soluble oligosaccharides was substantially increased by the presence of mut3264.

Example 23

Production of Soluble Oligosaccharides by Gtf-I and Mut3264 Mutanase

Reaction 1 comprised sucrose (100 g/L) and *E. coli* protein crude extract (3% v/v) containing the GTF-I from *Streptococcus sobrinus* (GI:450874, GTF0874; Example 8) in 50 mM phosphate buffer (pH 6.0). Reaction 2 comprised sucrose (100 g/L), *E. coli* protein crude extract (3% v/v) containing GTF-I from *Streptococcus sobrinus* (Example 8) and an *B. subtilis* protein crude extract (10%, v/v) containing *Paenibacillus humicus* mutanase (mut3264, GI:257153264, Example 13) in 50 mM phosphate buffer (pH 6.8). The total volume for each reaction was 10 mL and all reactions were performed at 30° C. with stirring by magnetic stir bar. Aliquots were withdrawn at 5 h, 24 h and 48 h, and reactions were quenched by heating aliquoted samples at 60° C. for 30 min. The insoluble materials were removed by centrifugation, and the resulting supernatant was analyzed by HPLC to determine the concentration of sucrose, glucose, fructose, leucrose and oligosaccharides (Table 13).

TABLE 13

| Monosaccharide, disaccharide and oligosaccharide concentrations measured by HPLC. | | | | | | | | | | | | | | | |
|---|---|---|---|---|---|---|---|---|---|---|---|---|---|---|---|
| Rxn # | Protein crude extract | Time (hr) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) | Leuc/ Fruc |
| 1 | none | 5 | 1.6 | 40.8 | 8.9 | 27.5 | 1.5 | 2.5 | 0.0 | 3.0 | 2.6 | 1.6 | 9.6 | 20.6 | 1.48 |
| | | 24 | 1.6 | 37.5 | 11.0 | 33.3 | 1.2 | 0.0 | 2.2 | 2.9 | 3.5 | 4.8 | 9.8 | 21.0 | 1.13 |
| | | 48 | 3.2 | 31.7 | 7.3 | 32.9 | 2.3 | 0.0 | 2.4 | 3.2 | 3.9 | 5.8 | 11.8 | 25.7 | 0.96 |
| 2 | *Bacillis* extract containing mut3264 | 5 | 3.6 | 33.0 | 9.8 | 31.5 | 0.3 | 2.5 | 0.0 | 6.4 | 5.7 | 5.1 | 14.9 | 32.6 | 1.05 |
| | | 24 | 6.7 | 32.1 | 11.0 | 33.3 | 0.3 | 0.6 | 1.7 | 4.5 | 5.9 | 8.8 | 13.0 | 29.4 | 0.96 |
| | | 48 | 6.5 | 28.2 | 11.8 | 32.1 | 0.5 | 1.2 | 2.7 | 5.6 | 6.2 | 9.2 | 16.2 | 36.6 | 0.88 |

Example 24

The Effect of GTF-I Glucosyltransferase and MUT3325 Mutanase Ratios on Oligosaccharides Production Reactions 1~4 comprised sucrose (100 g/L), a *T. reesei* protein crude extract (10% v/v) containing *Penicillium marneffei* ATCC® 18224 mutanase (mut3325); Example 14), and an *E. coli* protein crude extract containing GTF-I from *Streptococcus sobrinus* (GI:450874, GTF0874; Example 8) at one of 0.5%, 2.5%, 5% or 10% (v/v) in 50 mM potassium phosphate buffer at pH 5.4. Reactions 6-9 comprised sucrose (100 g/L), no added MUT3325, and an *E. coli* protein crude extract containing GTF-I from *Streptococcus sobrinus* (GI:450874; Example 4) at one of 0.5%, 2.5%, 5% or 10% (v/v) in 50 mM potassium phosphate buffer at pH 5.4. Reaction 5 contained only sucrose (100 g/L) in the same buffer. All reactions were performed at 37° C. with shaking at 125 rpm. Aliquots (500 μL) were withdrawn from each reaction at 1 h, 5 h and 25 h, and heated at 90° C. for 5 min to stop the reaction. Insoluble materials were removed by centrifugation and filtration. The resulting filtrate was analyzed by HPLC to determine the concentration of sucrose (Suc.), glucose (Gluc.), fructose (Fruc.), leucrose (Leuc.) and oligosaccharides (DP3-7) (Tables 14-16).

TABLE 14

Monosaccharide, disaccharide and oligosaccharide concentrations measured by HPLC (1 h).

| Rxn # | GTF-I % (v/v) | mut3325 % (v/v) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) |
|---|---|---|---|---|---|---|---|---|---|---|---|---|---|---|
| 1 | 10 | 10 | 42.3 | 11.7 | 3.2 | 25.0 | 0.0 | 6.7 | 1.8 | 5.3 | 0.0 | 0.0 | 13.9 | 49.5 |
| 2 | 5 | 10 | 69.8 | 5.0 | 2.6 | 13.7 | 0.2 | 1.2 | 2.1 | 2.3 | 1.0 | 0.0 | 6.9 | 47.2 |
| 3 | 2.5 | 10 | 84.5 | 1.5 | 1.9 | 7.6 | 0.0 | 0.6 | 1.3 | 1.7 | 0.8 | 0.0 | 4.3 | 57.0 |
| 4 | 0.5 | 10 | 90.4 | 0.0 | 1.0 | 5.1 | 0.0 | 0.4 | 0.9 | 1.4 | 0.7 | 0.0 | 3.3 | 71.6 |
| 5 | 0 | 0 | 99.5 | 0.0 | 0.9 | 0.0 | 0.0 | 0.0 | 0.0 | 0.0 | 0.0 | 0.0 | 0.0 | 0.0 |
| 6 | 10 | 0 | 63.1 | 9.1 | 4.9 | 14.3 | 0.0 | 0.4 | 1.0 | 1.1 | 0.9 | 0.6 | 3.3 | 18.5 |
| 7 | 5 | 0 | 85.4 | 2.6 | 3.7 | 6.3 | 0.0 | 0.0 | 0.2 | 0.4 | 0.4 | 0.3 | 1.1 | 15.2 |
| 8 | 2.5 | 0 | 92.4 | 0.7 | 2.6 | 3.0 | 0.0 | 0.0 | 0.0 | 0.0 | 0.0 | 0.0 | 0.0 | 0.0 |
| 9 | 0.5 | 0 | 97.9 | 0.0 | 1.1 | 0.7 | 0.0 | 0.0 | 0.0 | 0.0 | 0.0 | 0.0 | 0.0 | 0.0 |

TABLE 15

Monosaccharide, disaccharide and oligosaccharide concentrations measured by HPLC (5 h).

| Rxn # | GTF-I % (v/v) | mut3325 % (v/v) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) |
|---|---|---|---|---|---|---|---|---|---|---|---|---|---|---|
| 1 | 10 | 10 | 0.7 | 27.7 | 3.9 | 38.3 | 0.0 | 2.0 | 4.5 | 5.2 | 3.3 | 0.7 | 14.9 | 30.8 |
| 2 | 5 | 10 | 14.1 | 26.1 | 4.3 | 31.8 | 0.7 | 3.4 | 6.3 | 6.3 | 2.6 | 0.4 | 19.3 | 46.3 |
| 3 | 2.5 | 10 | 59.6 | 9.5 | 3.5 | 16.8 | 0.0 | 1.0 | 3.0 | 3.5 | 1.8 | 0.6 | 9.3 | 47.2 |
| 4 | 0.5 | 10 | 78.1 | 1.3 | 1.7 | 11.2 | 0.0 | 0.6 | 2.3 | 3.3 | 1.8 | 0.2 | 8.0 | 75.3 |
| 5 | 0 | 0 | 99.5 | 0.0 | 1.2 | 0.0 | 0.0 | 0.0 | 0.0 | 0.0 | 0.0 | 0.0 | 0.0 | 0.0 |
| 6 | 10 | 0 | 0.4 | 34.3 | 6.4 | 33.5 | 0.8 | 1.9 | 2.6 | 2.3 | 1.2 | 1.4 | 8.8 | 18.1 |
| 7 | 5 | 0 | 42.6 | 17.9 | 5.8 | 21.6 | 0.2 | 0.9 | 1.7 | 1.6 | 1.1 | 0.6 | 5.5 | 19.5 |
| 8 | 2.5 | 0 | 73.8 | 6.5 | 4.6 | 10.8 | 0.0 | 0.2 | 0.7 | 0.9 | 0.7 | 0.5 | 2.5 | 19.3 |
| 9 | 0.5 | 0 | 94.9 | 0.4 | 2.2 | 2.2 | 0.0 | 0.0 | 0.0 | 0.0 | 0.0 | 0.0 | 0.0 | 0.0 |

TABLE 16

Monosaccharide, disaccharide and oligosaccharide concentrations measured by HPLC (25 h).

| Rxn # | GTF-I % (v/v) | mut3325 % (v/v) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) |
|---|---|---|---|---|---|---|---|---|---|---|---|---|---|---|
| 1 | 10 | 10 | 4.8 | 29.4 | 2.8 | 34.8 | 0.0 | 0.7 | 1.9 | 4.0 | 6.1 | 6.9 | 12.7 | 27.4 |
| 2 | 5 | 10 | 4.0 | 33.4 | 3.2 | 33.0 | 0.0 | 0.5 | 3.7 | 6.4 | 7.5 | 5.8 | 18.1 | 38.6 |
| 3 | 2.5 | 10 | 2.7 | 33.7 | 4.2 | 33.9 | 0.0 | 1.4 | 5.9 | 8.0 | 6.9 | 4.5 | 22.2 | 46.7 |
| 4 | 0.5 | 10 | 34.4 | 14.6 | 3.6 | 27.1 | 0.0 | 0.8 | 6.0 | 7.8 | 4.9 | 2.5 | 19.4 | 60.8 |
| 5 | 0 | 0 | 98.0 | 0.0 | 1.5 | 0.9 | 0.0 | 0.0 | 0.0 | 0.0 | 0.0 | 0.0 | 0.0 | 0.0 |
| 6 | 10 | 0 | 0.5 | 33.6 | 5.8 | 34.2 | 0.7 | 1.7 | 2.3 | 2.2 | 1.8 | 0.9 | 8.7 | 17.9 |
| 7 | 5 | 0 | 0.4 | 34.8 | 5.7 | 33.1 | 0.8 | 2.0 | 2.6 | 2.3 | 1.5 | 1.6 | 9.2 | 19.0 |
| 8 | 2.5 | 0 | 0.5 | 36.9 | 6.0 | 32.8 | 0.9 | 2.2 | 3.1 | 2.8 | 1.3 | 0.0 | 10.3 | 21.3 |
| 9 | 0.5 | 0 | 74.1 | 7.3 | 4.7 | 10.8 | 0.2 | 0.7 | 1.0 | 0.8 | 0.5 | 0.0 | 3.1 | 24.9 |

A comparison of the data in Tables 14, 15, and 16 shows that sucrose conversion was faster in the presence of mut3325 at all concentrations of GTF-I. The total amount and yield of DP3 to DP7 significantly increased in the reactions in the presence of mut3325. Higher mut3325 to GTF-I ratio resulted in higher yields of DP3-DP7 oligosaccharides.

Example 25

The Effect of the GTF-J Glucosyltransferase and MUT3325 Mutanase Ratios on Oligosaccharides Production The reactions 1-3 below comprised 200 g/L sucrose, varied concentrations of GTF-J (GTF-J from *S. salivarius*; GI:47527, Example 3) (0.6 and 1% v/v) and varied concentrations of mut3325 (*Penicillium marneffei* ATCC® 18224 mutanase; Example 14) (10 and 20%) as indicated in the Table 10. All reactions were performed at 37° C. with tilt shaking at 125 rpm. The reactions were quenched after 16-19 h by heating at 90° C. for 5 min. The insoluble materials were removed by centrifugation and filtration. The soluble product mixture was analyzed by HPLC to determine the concentration of sucrose, glucose, fructose, leucrose and oligosaccharides (Table 17). The data in Table 17 shows that a higher ratio of mut3325 to GTF-J produced a higher yield of soluble DP3 to DP7 oligosaccharides.

TABLE 17

Monosaccharide, disaccharide and oligosaccharide concentrations measured by HPLC (25 h).

| Rxn # | GTF-J % (v/v) | mut3325 % (v/v) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) | Yield DP3-DP7 (%) |
|---|---|---|---|---|---|---|---|---|---|---|---|---|---|---|
| 1 | 1 | 10 | 1.6 | 56.0 | 2.9 | 70.0 | 0 | 0 | 4.0 | 6.1 | 6.8 | 2.6 | 16.9 | 17.5 |
| 2 | 0.6 | 10 | 1.0 | 54.4 | 3.2 | 71.0 | 0 | 0.2 | 7.6 | 8.7 | 8.7 | 2.2 | 25.3 | 26.0 |
| 3 | 0.6 | 20 | 5.1 | 50.0 | 0.0 | 78.2 | 0 | 0.2 | 12.6 | 17.4 | 15.0 | 8.9 | 45.2 | 47.6 |

Example 26

Effect of pH on the Oligosaccharide Production

The reactions 1-3 below comprised of sucrose (100 g/L), gtf-J (0.3% by volume, Example 3) and E coil crude protein extract containing mut3264 mutanase (10% volume, Example 12) at pH 5.0, 6.0 and 6.8. The buffers used for various pH were: 50 mM citrate buffer, pH 5.0; 50 mM phosphate, pH. 6.0 and 50 mM phosphate pH 6.8. The reactions were carried out at 30° C. with shaking at 125 rpm. Aliquots from each reaction were withdrawn at 5 hr, 24 hr, 48 hr and 72 hr and quenched by heating at 90° C. for 5 min. The insoluble materials were removed by centrifugation and filtration. The soluble product mixture was analyzed by HPLC to determine the concentration of sucrose, glucose, fructose, leucrose and oligosaccharides (Table 18). The data in Table 18 shows that DP4 oligosaccharide produced at pH 5.0 and pH 6.8 was further degraded by the mutanase to smaller DPs with prolonged incubation, while no further degradation was observed at pH 6.0.

TABLE 18

Monosaccharide, disaccharide and oligosaccharide concentrations measured by HPLC.

| Rxn # | GTF-J % (v/v) | *E. coli* mut3264 % (v/v) | pH | Time (h) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) |
|---|---|---|---|---|---|---|---|---|---|---|---|---|---|---|---|
| 1 | 0.3 | 10 | 5.0 | 5 | 46.4 | 12.8 | 3.5 | 30.8 | 0.0 | 0.1 | 0.0 | 13.7 | 7.7 | 4.0 | 21.6 |
| | | | | 24 | 12.2 | 19.1 | 2.2 | 43.9 | 0.0 | 0.0 | 0.0 | 14.7 | 11.9 | 8.7 | 26.6 |
| | | | | 48 | 18.3 | 19.1 | 0.9 | 43.3 | 0.0 | 0.0 | 0.0 | 9.1 | 14.2 | 15.1 | 23.3 |
| | | | | 72 | 25.6 | 22.0 | 2.3 | 43.5 | 0.0 | 0.0 | 0.0 | 4.4 | 13.3 | 18.2 | 17.7 |
| 2 | 0.3 | 10 | 6.0 | 5 | 38.3 | 10.2 | 3.9 | 30.8 | 0.0 | 0.1 | 0.0 | 13.8 | 8.1 | 4.1 | 22.0 |
| | | | | 24 | 9.6 | 19.1 | 4.3 | 41.0 | 0.0 | 0.0 | 0.0 | 14.8 | 11.0 | 8.1 | 25.8 |
| | | | | 48 | 10.7 | 20.5 | 4.7 | 43.5 | 0.0 | 0.0 | 0.0 | 15.0 | 11.5 | 8.5 | 26.5 |
| | | | | 72 | 9.3 | 18.2 | 2.1 | 40.4 | 0.0 | 0.0 | 0.0 | 14.4 | 11.2 | 8.2 | 25.6 |
| 3 | 0.3 | 10 | 6.8 | 5 | 39.2 | 9.4 | 3.6 | 29.0 | 0.0 | 0.1 | 0.0 | 13.4 | 7.2 | 3.7 | 20.8 |
| | | | | 24 | 8.7 | 18.9 | 1.7 | 40.1 | 0.0 | 0.0 | 0.0 | 13.8 | 11.5 | 8.9 | 25.3 |
| | | | | 48 | 13.7 | 19.1 | 0.9 | 40.1 | 0.0 | 0.0 | 0.0 | 8.9 | 12.5 | 13.6 | 21.4 |
| | | | | 72 | 14.3 | 18.6 | 0.1 | 39.0 | 0.0 | 0.0 | 0.0 | 7.7 | 12.7 | 14.3 | 20.4 |

Example 27

Effect of Temperature on the Oligosaccharide Production

The reactions 1-4 below comprised of sucrose (100 g/L), phosphate buffer (50 mM, pH 6.0), GTF-J (0.3% by volume, Example 3) and *E. coli* crude extract of mut3264 mutanase (10% by volume, Example 12). The reactions were carried out at 30° C., 40° C., 50° C. and 60° C. as specified in Table 19 with shaking at 125 rpm. The reactions were quenched after 24 hr by heating at 90° C. for 5 min. The insoluble materials were removed by centrifugation and filtration. The soluble product mixture was analyzed by HPLC to determine the concentration of sucrose, glucose, fructose, leucrose and oligosaccharides (Table 19). The total amount of oligosaccharides of DP3 to DP7 was the highest at 40° C.

TABLE 19

Monosaccharide, disaccharide and oligosaccharide concentrations measured by HPLC.

| Rxn # | GTF-J % (v/v) | *E. Coli* mut3264 % (v/v) | Temp. (° C.) | Time (h) | Suc. (g/L) | Leuc. (g/L) | Gluc. (g/L) | Fruc. (g/L) | DP7 (g/L) | DP6 (g/L) | DP5 (g/L) | DP4 (g/L) | DP3 (g/L) | DP2 (g/L) | DP3-DP7 (g/L) |
|---|---|---|---|---|---|---|---|---|---|---|---|---|---|---|---|
| 1 | 0.3 | 10 | 30 | 24 | 11.0 | 17.3 | 3.9 | 41.2 | 0 | 0.00 | 0 | 15.0 | 11.0 | 7.7 | 26.0 |
| 2 | 0.3 | 10 | 40 | 24 | 7.1 | 12.5 | 5.7 | 46.2 | 0 | 0.00 | 0 | 20.5 | 12.3 | 7.6 | 32.8 |
| 3 | 0.3 | 10 | 50 | 24 | 60.8 | 8.9 | 7.6 | 20.9 | 0 | 0.00 | 0 | 2.4 | 4.5 | 5.3 | 6.9 |
| 4 | 0.3 | 10 | 60 | 24 | 103.5 | 0.0 | 0.4 | 1.2 | 0 | 0.00 | 0 | 0.2 | 0.0 | 0.0 | 0.2 |

Example 28

Effect of MUT6505 Mutanase on the Sucrose Consumption by GTF-J

Various concentrations of a *T. reesei* crude protein extract containing mut6505 (*Aspergillus nidulans* FGSC A4 mutanase GI:259486505; Example 16) as indicated in Table 20 (below) were incubated with 100 g/L sucrose, and 0.3% (v/v) of an *E. coli* crude protein extract containing GTF-J (Example 3) in final volumes of 1 mL. The reactions were incubated at 37° C. with shaking 150 rpm for 3 h. Reactions were quenched by heating at 90° C. for 3 min. The insoluble materials were removed by centrifugation and filtration through 0.2 μm sterile filter. The filtrate was analyzed on HPLC as described in the general methods. The data (Table 20) show that faster sucrose consumption correlates with increased mutanase concentration.

TABLE 20

Effect of mut6505 mutanase on sucrose conversion by GTF-J. 100 g/L sucrose, 0.3% (v/v) GTF-J extract, 37° C., 3 h

| | 10% mut6505 | 4% mut6505 | 1% mut6505 |
|---|---|---|---|
| DP6 | 0.0 | 0.0 | 0.0 |
| DP5 | 0.0 | 0.0 | 0.0 |
| DP4 | 0.3 | 0.2 | 0.0 |
| DP3 | 2.8 | 1.4 | 0.8 |
| DP2 | 3.1 | 2.0 | 1.6 |
| Sucrose | 48.9 | 71.5 | 78.9 |
| Leucrose | 8.7 | 4.8 | 3.1 |
| Glucose | 16.2 | 8.4 | 6.2 |
| Fructose | 23.5 | 12.8 | 9.7 |
| DP2-DP7 | 6.1 | 3.6 | 2.4 |
| DP3-DP7 | 3.0 | 1.6 | 0.8 |
| Total | 103.3 | 101.2 | 100.4 |

Example 29

Production of Oligosaccharides by GTF-S and MUT3264

Reactions comprised sucrose (100 g/L), *E. coli* crude protein extract containing GTF-S (*Streptococcus* sp. C150 GI:495810459, GTF0459; Example 9) (10% v/v) in 50 mM phosphate buffer, pH 6.0, or comprised sucrose (100 g/L), *E. coli* crude protein extract containing GTF-S (*Streptococcus* sp. C150 GI:495810459, GTF0459; Example 9) (10% v/v) and *E. coli* crude protein extract containing mut3264 (10% (v/v); Example 12) in 50 mM phosphate buffer, pH 6.0. The total volume for each reaction was 10 mL and all reactions were performed at 37° C. with shaking at 125 rpm. Aliquots were withdrawn at 3, 6, 23 and 26 h and reactions were quenched by heating at 95° C. for 5 min. The insoluble materials were removed by centrifugation and filtration. The filtrate was analyzed by HPLC to determine the concentration of sucrose, glucose, fructose, leucrose and oligosaccharides (Table 21).

TABLE 21

| Monosaccharide, disaccharide and oligosaccharide concentrations measured by HPLC. | | | | | | | | | | | | | | |
|---|---|---|---|---|---|---|---|---|---|---|---|---|---|---|
| Gtf GI | comments | Time, (h) | Suc. (g/L) | Leuc. (g/L) | Gluc. (g/L) | Fruc. (g/L) | DP8+ (g/L) | DP7 (g/L) | DP6 (g/L) | DP5 (g/L) | DP4 (g/L) | DP3 (g/L) | Sum DP3-7 (g/L) | DP2 (g/L) |
| GTF0459 | 10% GTF | 3 | 79.1 | 0.7 | 3.5 | 11.8 | 0.0 | 0.3 | 0.5 | 0.7 | 0.9 | 1.3 | 3.6 | 1.2 |
| | | 6 | 58.3 | 1.9 | 4.3 | 22.0 | 4.6 | 1.9 | 1.9 | 1.8 | 1.7 | 1.9 | 9.2 | 1.9 |
| | | 23 | 8.9 | 5.9 | 4.2 | 44.5 | 17.2 | 4.1 | 3.8 | 3.3 | 2.8 | 2.8 | 16.8 | 2.5 |
| | | 26 | 4.6 | 6.5 | 4.3 | 46.8 | 17.7 | 4.3 | 4.0 | 3.5 | 3.0 | 2.8 | 17.5 | 2.6 |
| GTF0459 | 10% GTF + mut3264 | 3 | 77.9 | 0.8 | 4.0 | 12.8 | 0.0 | 0.0 | 3.8 | 0.2 | 2.7 | 2.4 | 5.4 | 2.2 |
| | | 6 | 52.3 | 2.0 | 6.5 | 25.9 | 0.0 | 0.0 | 0.1 | 1.1 | 7.2 | 4.8 | 13.3 | 4.1 |
| | | 23 | 9.4 | 4.9 | 10.1 | 48.3 | 3.8 | 2.1 | 2.2 | 2.0 | 1.8 | 2.1 | 10.2 | 2.2 |
| | | 26 | 9.9 | 4.9 | 10.1 | 48.2 | 0.0 | 0.2 | 0.6 | 1.3 | 13.9 | 10.5 | 26.4 | 10.5 |

Example 30

Isolation of Soluble Oligosaccharide Fiber Produced by the Combination of GTF-J and MUT3264

A 200 mL reaction containing 200 g/L sucrose, *E. coli* concentrated crude protein extract (1.0% v/v) containing GTF-J from *S. salivarius* (GI:47527, GTF7527; Example 3), and *E. coli* crude protein extract (10% v/v) containing *Paenibacillus humicus* mutanase (MUT3264, GI:257153264; Example 12) in distilled, deionized $H_2O$, was stirred at 30° C. for 20 h, then heated to 90° C. for 15 min to inactivate the enzymes. The resulting product mixture was centrifuged and the resulting supernatant analyzed by HPLC for soluble monosaccharides, disaccharides and oligosaccharides, then 88 mL of the supernatant was purified by SEC using BioGel P2 resin (BioRad). The SEC fractions that contained oligosaccharides DP3 were combined and concentrated by rotary evaporation for analysis by HPLC (Table 22).

TABLE 22

| Soluble oligosaccharide oligomer/polymer produced by GTF-J/mut3264. 200 g/L sucrose, GTF-J, mut3264, 30° C., 20 h | Product mixture, g/L | SEC-purified product, g/L |
|---|---|---|
| DP7 | 0 | 0 |
| DP6 | 0 | 0 |
| DP5 | 0 | 0.4 |
| DP4 | 18.0 | 146.9 |
| DP3 | 11.2 | 26.8 |
| DP2 | 10.1 | 0.0 |
| Sucrose | 8.6 | 0.0 |
| Leucrose | 71.4 | 0.0 |
| Glucose | 11.4 | 0.0 |
| Fructose | 68.3 | 0.0 |
| Sum DP2-DP7 | 39.3 | 174.1 |
| Sum DP3-DP7 | 29.2 | 174.1 |

Example 31

Isolation of Soluble Oligosaccharide Fiber Produced by the Combination of GTF-L and MUT3264

A 100 mL reaction containing 210 g/L sucrose, *E. coli* concentrated crude protein extract (10% v/v) containing GTF-L from *S. salivarius* (GI #662379; Example 5), and *E. coli* crude protein extract (10% v/v) comprising a *Paenibacillus humicus* mutanase (MUT3264, GI:257153264; Example 12) in distilled, deionized $H_2O$, was stirred at 37° C. for 24 h, then heated to 90° C. for 15 min to inactivate the enzymes. The resulting product mixture was centrifuged and the resulting supernatant analyzed by HPLC for soluble monosaccharides, disaccharides and oligosaccharides, then 88 mL of the supernatant was purified by SEC using BioGel P2 resin (BioRad). The SEC fractions that contained oligosaccharides DP3 were combined and concentrated by rotary evaporation for analysis by HPLC (Table 23).

TABLE 23

| Soluble oligosaccharide oligomer/polymer produced by GTF-L/mut3264 mutanase. 210 g/L sucrose, GTF-L, mut3264, 37° C., 24 h | Product mixture, g/L | SEC-purified product, g/L |
|---|---|---|
| DP7 | 4.6 | 13.6 |
| DP6 | 6.6 | 16.6 |
| DP5 | 8.0 | 20.5 |
| DP4 | 11.7 | 20.2 |
| DP3 | 12.4 | 5.7 |
| DP2 | 22.0 | 1.1 |
| Sucrose | 10.6 | 0.6 |
| Leucrose | 59.0 | 0.0 |
| Glucose | 12.6 | 0.0 |
| Fructose | 71.5 | 0.0 |
| Sum DP2-DP7 | 65.3 | 77.7 |
| Sum DP3-DP7 | 43.3 | 76.6 |

Example 32

Isolation of Soluble Oligosaccharide Fiber Produced by the Combination of GTF-J and MUT3325

A 100 mL reaction containing 210 g/L sucrose, *E. coli* concentrated crude protein extract (0.6% v/v) containing GTF-J from *S. salivarius* (GI #47527; Example 3) and *T. reesei* crude protein extract (20% v/v) comprising a mutanase from *Penicillium marneffei* ATCC® 18224 (mut3325, GI:212533325; Example 14) in distilled, deionized $H_2O$, was stirred at 37° C. for 24 h, then heated to 90° C. for 15 min to inactivate the enzymes. The resulting product mixture was centrifuged and the resulting supernatant analyzed by HPLC for soluble monosaccharides, disaccharides and oligosaccharides, then 84 mL of the supernatant was purified by SEC using BioGel P2 resin (BioRad). The SEC fractions that contained oligosaccharides DP3 were combined and concentrated by rotary evaporation for analysis by HPLC (Table 24).

TABLE 24

Soluble oligosaccharide oligomer/polymer produced by GTF-J/mut3325 mutanase. 210 g/L sucrose, GTF-J, mut3325, 37° C., 24 h

| | Product mixture, g/L | SEC-purified product, g/L |
|---|---|---|
| DP7 | 0.0 | 0.0 |
| DP6 | 0.3 | 0.0 |
| DP5 | 14.1 | 60.2 |
| DP4 | 18.8 | 63.9 |
| DP3 | 16.0 | 18.9 |
| DP2 | 3.2 | 0.0 |
| Sucrose | 3.6 | 0.0 |
| Leucrose | 48.6 | 0.0 |
| Glucose | 4.9 | 0.0 |
| Fructose | 78.3 | 0.0 |
| Sum DP2-DP7 | 52.4 | 143.0 |
| Sum DP3-DP7 | 49.2 | 143.0 |

Example 33

Isolation of Soluble Oligosaccharide Fiber Produced by the Combination of GTF-I and MUT3325

A 100 mL reaction containing 200 g/L sucrose, *E. coli* protein crude extract (5% v/v) containing the GTF-I from *Streptococcus sobrinus* (GI:450874, Example 8) and *T. reesei* crude protein extract (15% v/v) comprising a mutanase from *Penicillium marneffei* ATCC® 18224 (MUT3325, GI:212533325; Example 14) in distilled, deionized $H_2O$, was stirred at 37° C. for 24 h, then heated to 90° C. for 15 min to inactivate the enzymes. The resulting product mixture was centrifuged and the resulting supernatant analyzed by HPLC for soluble monosaccharides, disaccharides and oligosaccharides, then 87 mL of the supernatant was purified by SEC using BioGel P2 resin (BioRad). The SEC fractions that contained oligosaccharides DP3 were combined and concentrated by rotary evaporation for analysis by HPLC (Table 25).

TABLE 25

Soluble oligosaccharide oligomer/polymer produced by GTF-I/mut3325 mutanase. 200 g/L sucrose, GTF-I, mut3325, 37° C., 24 h

| | Product mixture, g/L | SEC-purified product, g/L |
|---|---|---|
| DP7 | 1.5 | 12.3 |
| DP6 | 4.4 | 16.0 |
| DP5 | 14.5 | 60.5 |
| DP4 | 16.8 | 53.8 |
| DP3 | 12.3 | 15.0 |
| DP2 | 2.3 | 0.0 |
| Sucrose | 4.8 | 0.0 |
| Leucrose | 76.8 | 0.0 |

TABLE 25-continued

Soluble oligosaccharide oligomer/polymer produced by GTF-I/mut3325 mutanase. 200 g/L sucrose, GTF-I, mut3325, 37° C., 24 h

| | Product mixture, g/L | SEC-purified product, g/L |
|---|---|---|
| Glucose | 6.7 | 0.0 |
| Fructose | 62.3 | 0.2 |
| Sum DP2-DP7 | 51.7 | 157.6 |
| Sum DP3-DP7 | 49.4 | 157.6 |

Example 34

Isolation of Soluble Oligosaccharide Fiber Produced by the Combination of GTF-S and MUT3264

A 200 mL reaction containing 210 g/L sucrose, *E. coli* crude protein extract (10% v/v) containing GTF-S from *Streptococcus* sp. C150 (GI:495810459; Example 9), and *E. coli* crude protein extract (10% v/v) comprising a mutanase from *Paenibacillus humicus* (MUT3264, GI:257153264; Example 12) in distilled, deionized $H_2O$, was stirred at 37° C. for 40 h, then stored for 84 h at 4° C. prior to heating to 90° C. for 15 min to inactivate the enzymes. The resulting product mixture was centrifuged and the resulting supernatant analyzed by HPLC for soluble monosaccharides, disaccharides and oligosaccharides, then the supernatant was purified by SEC using BioGel P2 resin (BioRad). The SEC fractions that contained oligosaccharides DP3 were combined and concentrated by rotary evaporation for analysis by HPLC (Table 26).

TABLE 26

Soluble oligosaccharide fiber produced by GTF-S/mut3264 mutanase. 210 g/L sucrose, GTF-S, mut3264, 37° C., 40 h

| | Product mixture, g/L | SEC-purified product, g/L |
|---|---|---|
| DP7 | 10.0 | 22.6 |
| DP6 | 12.4 | 42.2 |
| DP5 | 19.4 | 83.3 |
| DP4 | 19.9 | 74.1 |
| DP3 | 13.4 | 22.6 |
| DP2 | 10.4 | 0 |
| Sucrose | 13.4 | 0 |
| Leucrose | 12.7 | 0 |
| Glucose | 8.9 | 0 |
| Fructose | 95.7 | 0 |
| Sum DP2-DP7 | 85.5 | 244.8 |
| Sum DP3-DP7 | 75.1 | 244.8 |

Example 35

Isolation of Soluble Oligosaccharide Fiber Produced by the Combination of GTF-B and MUT3264

A 200 mL reaction containing 100 g/L sucrose, *E. coli* crude protein extract (10% v/v) containing GTF-B from *Streptococcus mutans* NN2025 (GI:290580544, Example 6), and *E. coli* crude protein extract (10% v/v) comprising a mutanase from *Paenibacillus humicus* (MUT3264, GI:257153264; Example 12) in distilled, deionized $H_2O$, was stirred at 37° C. for 24 h, then heated to 90° C. for 15 min to inactivate the enzymes. The resulting product mixture was centrifuged and the resulting supernatant analyzed by HPLC for soluble monosaccharides, disaccharides and oligosaccharides, then 132 mL of the supernatant was purified by SEC using BioGel P2 resin (BioRad). The SEC fractions that contained oligosaccharides DP3 were combined and concentrated by rotary evaporation for analysis by HPLC (Table 27).

TABLE 27

Soluble oligosaccharide oligomer/polymer produced by GTF-B/mut3264 mutanase. 100 g/L sucrose, GTF-B, mut3264, 37° C., 24 h

| | Product mixture, g/L | SEC-purified product, g/L |
|---|---|---|
| DP7 | 2.8 | 11.7 |
| DP6 | 4.0 | 14.0 |
| DP5 | 4.3 | 13.2 |
| DP4 | 3.5 | 9.4 |
| DP3 | 4.4 | 2.4 |
| DP2 | 9.8 | 0.0 |
| Sucrose | 10.3 | 0.2 |
| Leucrose | 15.6 | 0.0 |
| Glucose | 2.9 | 0.0 |
| Fructose | 41.7 | 0.1 |
| Sum DP2-DP7 | 28.8 | 50.7 |
| Sum DP3-DP7 | 19.0 | 50.7 |

Example 36

Isolation of Soluble Oligosaccharide Fiber Produced by the Combination of GTF-S and MUT3325

A 600 mL reaction containing 300 g/L sucrose, *B. subtilis* crude protein extract (20% v/v) containing GTF-S from *Streptococcus* sp. C150 (GI:495810459; Example 11), and *T. reesei* crude protein extract (2.5% v/v) comprising a mutanase from *Penicillium marneffei* ATCC® 18224 (MUT3325, GI:212533325; Example 14) in distilled, deionized $H_2O$, was shaken at 125 rpm and 37° C. for 27.5 h, then heated in a microwave oven (1000 Watts) for 4 min to inactivate the enzymes. The resulting product mixture was centrifuged and the resulting supernatant analyzed by HPLC for soluble monosaccharides, disaccharides and oligosaccharides, then entire supernatant was purified by SEC using BioGel P2 resin (BioRad). The SEC fractions that contained oligosaccharides DP3 were combined and concentrated by rotary evaporation for analysis by HPLC (Table 28).

TABLE 28

Soluble oligosaccharide fiber produced by GTF-S/mut3325 mutanase. 300 g/L sucrose, GTF-S, mut3325, 37° C., 24 h

| | Product mixture, g/L | SEC-purified product, g/L |
|---|---|---|
| DP7 | 4.7 | 10.4 |
| DP6 | 16.4 | 31.1 |

TABLE 28-continued

Soluble oligosaccharide fiber produced by GTF-S/mut3325 mutanase. 300 g/L sucrose, GTF-S, mut3325, 37° C., 24 h

| | Product mixture, g/L | SEC-purified product, g/L |
|---|---|---|
| DP5 | 27.1 | 47.5 |
| DP4 | 30.8 | 38.8 |
| DP3 | 25.6 | 30.5 |
| DP2 | 12.8 | 4.1 |
| Sucrose | 14.0 | 2.5 |
| Leucrose | 18.5 | 0.0 |
| Glucose | 13.0 | 1.4 |
| Fructose | 138.2 | 0.4 |
| Sum DP2-DP7 | 117.5 | 162.4 |
| Sum DP3-DP7 | 104.7 | 158.3 |

Example 37

Isolation of Soluble Oligosaccharide Fiber Produced by GTF-J

A 3000 mL reaction containing 200 g/L sucrose and *E. coli* concentrated crude protein extract (1.0% v/v) containing GTF-J from *S. salivarius* (GI #47527; Example 3) in distilled, deionized $H_2O$, was shaken at 125 rpm at pH 5.5 and 47° C. for 21 h, then heated to 60° C. for 30 min to inactivate the enzyme. The resulting product mixture was centrifuged and the resulting supernatant was analyzed by HPLC for soluble monosaccharides, disaccharides and oligosaccharides; the supernatant was then concentrated to 900 mL by rotary evaporation and purified by SEC using BioGel P2 resin (BioRad). The SEC fractions that contained oligosaccharides DP3 were combined and concentrated by rotary evaporation for analysis by HPLC (Table 29).

TABLE 29

Soluble oligosaccharide fiber produced by GTF-J. 200 g/L sucrose, GTF-J, 47° C., 24 h

| | Product mixture, g/L | SEC-purified product, g/L |
|---|---|---|
| DP7 | 0.8 | 2.4 |
| DP6 | 1.5 | 6.5 |
| DP5 | 2.9 | 24.0 |
| DP4 | 4.8 | 26.9 |
| DP3 | 6.5 | 10.7 |
| DP2 | 9.1 | 2.1 |
| Sucrose | 0.7 | 1.5 |
| Leucrose | 55.0 | 0.0 |
| Glucose | 11.9 | 0.3 |
| Fructose | 73.6 | 0.6 |
| Sum DP2-DP7 | 25.6 | 72.6 |
| Sum DP3-DP7 | 16.5 | 70.5 |

Example 37A

Isolation of Soluble Oligosaccharide Fiber Produced by the Combination of GTF-S Homolog GTF0974 and MUT3325

A 250 mL reaction containing 450 g/L sucrose, *B. subtilis* crude protein extract (5% v/v) containing GTF0974 from

*Streptococcus salivarius* 57.1 (GI: 387760974; Examples 11A and 11 D), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 21 h, then heated to 90° C. for 30 min to inactivate the enzymes. The resulting product mixture was centrifuged and the resulting supernatant analyzed by HPLC for soluble monosaccharides, disaccharides and oligosaccharides (Table 30), then the oligosaccharides were isolated from the supernatant by SEC at 40° C. using Diaion UBK 530 (Na+ form) resin (Mitsubishi). The SEC fractions that contained oligosaccharides ≥DP3 were combined and concentrated by rotary evaporation for analysis by HPLC (Table 30). The combined SEC fractions were diluted to 5 wt % dry solids (DS) and freeze-dried to produce the fiber as a dry solid.

TABLE 30

Soluble oligosaccharide fiber produced by GTF0974/mut3325 mutanase. 450 g/L sucrose, GTF0974, mut3325, 47° C., 21 h

| | Product mixture, g/L | SEC-purified product, g/L | SEC-purified product % (wt/wt DS) |
|---|---|---|---|
| DP7+ | 80.6 | 35.5 | 35.3 |
| DP6 | 34.8 | 19.4 | 19.3 |
| DP5 | 37.0 | 17.9 | 17.8 |
| DP4 | 33.7 | 15.7 | 15.6 |
| DP3 | 18.2 | 8.0 | 8.0 |
| DP2 | 12.1 | 1.8 | 1.8 |
| Sucrose | 10.1 | 0.5 | 0.5 |
| Leucrose | 43.4 | 1.7 | 1.7 |
| Glucose | 6.9 | 0.0 | 0.0 |
| Fructose | 200.2 | 0.0 | 0.0 |
| Sum DP2-DP7+ | 216.4 | 98.3 | 97.8 |
| Sum DP3-DP7+ | 204.3 | 96.5 | 96.0 |

Example 37B

Isolation of Soluble Oligosaccharide Fiber Produced by the Combination of GTF-S Homolog GTF4336 and MUT3325

A 250 mL reaction containing 450 g/L sucrose, *B. subtilis* crude protein extract (5% v/v) containing GTF4336 from *Streptococcus salivarius* SK126 (GI: 488974336; Examples 11A and 11D), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 21 h, then heated to 90° C. for 30 min to inactivate the enzymes. The resulting product mixture was centrifuged and the resulting supernatant analyzed by HPLC for soluble monosaccharides, disaccharides and oligosaccharides (Table 31), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 31). The combined SEC fractions were diluted to 5 wt % dry solids (DS) and freeze-dried to produce the fiber as a dry solid.

TABLE 31

Soluble oligosaccharide fiber produced by GTF4336/mut3325 mutanase. 450 g/L sucrose, GTF4336, mut3325, 47° C., 21 h

| | Product mixture, g/L | SEC-purified product, g/L | SEC-purified product % (wt/wt DS) |
|---|---|---|---|
| DP7+ | 87.0 | 21.0 | 21.6 |
| DP6 | 31.6 | 20.5 | 21.2 |
| DP5 | 29.8 | 23.5 | 24.2 |
| DP4 | 23.4 | 20.8 | 21.4 |
| DP3 | 12.8 | 8.4 | 8.6 |
| DP2 | 8.8 | 2.6 | 2.7 |
| Sucrose | 54.7 | 0.2 | 0.2 |
| Leucrose | 35.3 | 0.1 | 0.1 |
| Glucose | 6.9 | 0.0 | 0.0 |
| Fructose | 182.5 | 0.0 | 0.0 |
| Sum DP2-DP7+ | 193.3 | 96.8 | 99.7 |
| Sum DP3-DP7+ | 184.5 | 94.2 | 97.0 |

Example 37C

Isolation of Soluble Oligosaccharide Fiber Produced by the Combination of GTF-S Homolog GTF0470 and MUT3325

A 250 mL reaction containing 450 g/L sucrose, *B. subtilis* crude protein extract (5% v/v) containing GTF0470 from *Streptococcus salivarius* K12 (GI: 488980470; Examples 11A and 11D), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 44 h, then heated to 90° C. for 30 min to inactivate the enzymes. The resulting product mixture was centrifuged and the resulting supernatant analyzed by HPLC for soluble monosaccharides, disaccharides and oligosaccharides (Table 32), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 32). The combined SEC fractions were diluted to 5 wt % dry solids (DS) and freeze-dried to produce the fiber as a dry solid.

TABLE 32

Soluble oligosaccharide fiber produced by GTF0470/mut3325 mutanase. 450 g/L sucrose, GTF0470, mut3325, 47° C., 44 h

| | Product mixture, g/L | SEC-purified product, g/L | SEC-purified product % (wt/wt DS) |
|---|---|---|---|
| DP7+ | 48.3 | 29.3 | 27.4 |
| DP6 | 37.5 | 23.6 | 22.0 |
| DP5 | 39.6 | 23.9 | 22.3 |
| DP4 | 36.7 | 19.6 | 18.3 |
| DP3 | 17.2 | 7.7 | 7.2 |
| DP2 | 7.7 | 1.9 | 1.8 |
| Sucrose | 10.1 | 0.5 | 0.5 |
| Leucrose | 40.5 | 0.5 | 0.4 |
| Glucose | 6.8 | 0.0 | 0.0 |
| Fructose | 199.6 | 0.0 | 0.0 |
| Sum DP2-DP7+ | 186.9 | 105.9 | 99.0 |
| Sum DP3-DP7+ | 179.2 | 104.0 | 97.2 |

Example 37D

Isolation of Soluble Oligosaccharide Fiber Produced by the Combination of GTF-S Homolog GTF6549 and MUT3325

A 250 mL reaction containing 450 g/L sucrose, *B. subtilis* crude protein extract (7.5% v/v) containing GTF6549 from *Streptococcus salivarius* M18 (GI: 490286549; Examples 11A and 11D), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 53 h, then heated to 90° C. for 30 min to inactivate the enzymes. The resulting product mixture was centrifuged and the resulting supernatant analyzed by HPLC for soluble monosaccharides, disaccharides and oligosaccharides (Table 33), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 33). The combined SEC fractions were diluted to 5 wt % dry solids (DS) and freeze-dried to produce the fiber as a dry solid.

TABLE 33

Soluble oligosaccharide fiber produced by GTF6549/mut3325 mutanase. 450 g/L sucrose, GTF6549, mut3325, 47° C., 53 h

| | Product mixture, g/L | SEC-purified product, g/L | SEC-purified product % (wt/wt DS) |
|---|---|---|---|
| DP7+ | 41.9 | 30.1 | 28.4 |
| DP6 | 41.6 | 25.0 | 23.7 |
| DP5 | 41.0 | 22.6 | 21.4 |
| DP4 | 35.9 | 17.9 | 16.9 |
| DP3 | 22.2 | 7.4 | 7.0 |
| DP2 | 10.7 | 1.8 | 1.7 |
| Sucrose | 15.3 | 0.6 | 0.5 |
| Leucrose | 41.2 | 0.3 | 0.3 |
| Glucose | 6.3 | 0.0 | 0.0 |
| Fructose | 193.2 | 0.0 | 0.0 |
| Sum DP2-DP7+ | 193.3 | 104.8 | 99.2 |
| Sum DP3-DP7+ | 182.6 | 103.0 | 97.5 |

Example 37E

Isolation of Soluble Oligosaccharide Fiber Produced by the Combination of GTF-S Homolog GTF4491 and MUT3325

A 250 mL reaction containing 450 g/L sucrose, *B. subtilis* crude protein extract (5% v/v) containing GTF4491 from *Streptococcus salivarius* JIM8777 (GI: 387784491; Examples 11A and 11D), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 22 h, then heated to 90° C. for 30 min to inactivate the enzymes. The resulting product mixture was centrifuged and the resulting supernatant analyzed by HPLC for soluble monosaccharides, disaccharides and oligosaccharides (Table 34), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 34). The combined SEC fractions were diluted to 5 wt % dry solids (DS) and freeze-dried to produce the fiber as a dry solid.

TABLE 34

Soluble oligosaccharide fiber produced by GTF4491/mut3325 mutanase. 450 g/L sucrose, GTF4491, mut3325, 47° C., 22 h

| | Product mixture, g/L | SEC-purified product, g/L | SEC-purified product % (wt/wt DS) |
|---|---|---|---|
| DP7+ | 89.7 | 46.9 | 44.5 |
| DP6 | 30.8 | 18.3 | 17.4 |
| DP5 | 29.2 | 18.2 | 17.3 |
| DP4 | 23.1 | 13.7 | 13.0 |
| DP3 | 11.5 | 5.2 | 4.9 |
| DP2 | 7.4 | 1.8 | 1.7 |
| Sucrose | 17.1 | 0.6 | 0.6 |
| Leucrose | 35.7 | 0.5 | 0.5 |
| Glucose | 8.7 | 0.0 | 0.0 |
| Fructose | 186.3 | 0.0 | 0.0 |
| Sum DP2-DP7+ | 191.6 | 104.1 | 98.9 |
| Sum DP3-DP7+ | 184.2 | 102.3 | 97.2 |

Example 37F

Isolation of Soluble Oligosaccharide Fiber Produced by the Combination of GTF-S Homolog GTF1645 and MUT3325

A 250 mL reaction containing 450 g/L sucrose, *B. subtilis* crude protein extract (5% v/v) containing GTF1645 from *Streptococcus* sp. HSISS3 (GI: 544721645; Example 11A), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 46 h, then heated to 90° C. for 30 min to inactivate the enzymes. The resulting product mixture was centrifuged and the resulting supernatant analyzed by HPLC for soluble monosaccharides, disaccharides and oligosaccharides (Table 35), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 35). The combined SEC fractions were diluted to 5 wt % dry solids (DS) and freeze-dried to produce the fiber as a dry solid.

TABLE 35

Soluble oligosaccharide fiber produced by GTF1645/mut3325 mutanase. 450 g/L sucrose, GTF1645, mut3325, 47° C., 46 h

| | Product mixture, g/L | SEC-purified product, g/L | SEC-purified product % (wt/wt DS) |
|---|---|---|---|
| DP7+ | 0.0 | 15.7 | 15.3 |
| DP6 | 50.8 | 24.7 | 24.2 |
| DP5 | 39.2 | 24.9 | 24.4 |
| DP4 | 39.6 | 23.2 | 22.7 |
| DP3 | 29.8 | 10.6 | 10.4 |
| DP2 | 11.7 | 2.2 | 2.1 |
| Sucrose | 14.3 | 0.6 | 0.6 |
| Leucrose | 30.1 | 0.2 | 0.2 |

TABLE 35-continued

| Soluble oligosaccharide fiber produced by GTF1645/mut3325 mutanase. 450 g/L sucrose, GTF1645, mut3325, 47° C., 46 h | | | |
|---|---|---|---|
| | Product mixture, g/L | SEC-purified product, g/L | SEC-purified product % (wt/wt DS) |
| Glucose | 8.2 | 0.0 | 0.0 |
| Fructose | 192.6 | 0.0 | 0.0 |
| Sum DP2-DP7+ | 171.0 | 101.2 | 99.2 |
| Sum DP3-DP7+ | 159.3 | 99.0 | 97.1 |

Example 37G

Isolation of Soluble Oligosaccharide Fiber Produced by the Combination of GTF-S Homolog GTF6099 and MUT3325

A 250 mL reaction containing 450 g/L sucrose, *B. subtilis* crude protein extract (5% v/v) containing GTF6099 from *Streptococcus* sp. HSISS2 (GI: 544716099; Example 11A), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 52 h, then heated to 90° C. for 30 min to inactivate the enzymes. The resulting product mixture was centrifuged and the resulting supernatant analyzed by HPLC for soluble mono-saccharides, disaccharides and oligosaccharides (Table 36), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 36). The combined SEC fractions were diluted to 5 wt % dry solids (DS) and freeze-dried to produce the fiber as a dry solid.

TABLE 36

| Soluble oligosaccharide fiber produced by GTF6099/mut3325 mutanase. 450 g/L sucrose, GTF6099, mut3325, 47° C., 52 h | | | |
|---|---|---|---|
| | Product mixture, g/L | SEC-purified product, g/L | SEC-purified product % (wt/wt DS) |
| DP7+ | 0.0 | 16.1 | 16.0 |
| DP6 | 57.0 | 23.7 | 23.5 |
| DP5 | 43.9 | 26.3 | 26.1 |
| DP4 | 42.7 | 22.1 | 21.9 |
| DP3 | 29.1 | 9.7 | 9.6 |
| DP2 | 11.9 | 2.1 | 2.1 |
| Sucrose | 15.7 | 0.5 | 0.5 |
| Leucrose | 34.4 | 0.2 | 0.2 |
| Glucose | 7.6 | 0.0 | 0.0 |
| Fructose | 190.9 | 0.0 | 0.0 |
| Sum DP2-DP7+ | 184.6 | 99.9 | 99.3 |
| Sum DP3-DP7+ | 172.8 | 97.8 | 97.2 |

Example 37H

Isolation of Soluble Oligosaccharide Fiber Produced by the Combination of GTF-S Homolog GTF7317 and MUT3325

A 250 mL reaction containing 450 g/L sucrose, *B. subtilis* crude protein extract (5% v/v) containing GTF7317 from *Streptococcus salivarius* PS4 (GI: 488977317; Example 11A), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 46 h, then heated to 90° C. for 30 min to inactivate the enzymes. The resulting product mixture was centrifuged and the resulting supernatant analyzed by HPLC for soluble mono-saccharides, disaccharides and oligosaccharides (Table 37), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 37). The combined SEC fractions were diluted to 5 wt % dry solids (DS) and freeze-dried to produce the fiber as a dry solid.

TABLE 37

| Soluble oligosaccharide fiber produced by GTF7317/mut3325 mutanase. 450 g/L sucrose, GTF7317, mut3325, 47° C., 46 h | | | |
|---|---|---|---|
| | Product mixture, g/L | SEC-purified product, g/L | SEC-purified product % (wt/wt DS) |
| DP7+ | 0.0 | 16.5 | 16.0 |
| DP6 | 57.1 | 23.0 | 22.4 |
| DP5 | 43.7 | 25.8 | 25.2 |
| DP4 | 42.6 | 23.2 | 22.6 |
| DP3 | 28.7 | 11.0 | 10.7 |
| DP2 | 11.6 | 2.3 | 2.2 |
| Sucrose | 13.8 | 0.6 | 0.6 |
| Leucrose | 35.8 | 0.3 | 0.3 |
| Glucose | 6.9 | 0.0 | 0.0 |
| Fructose | 192.5 | 0.0 | 0.0 |
| Sum DP2-DP7+ | 183.6 | 101.6 | 99.1 |
| Sum DP3-DP7+ | 172.0 | 99.3 | 96.9 |

Example 371

Isolation of Soluble Oligosaccharide Fiber Produced by the Combination of GTF-S Homolog GTF8487 and MUT3325

A 250 mL reaction containing 450 g/L sucrose, *B. subtilis* crude protein extract (5% v/v) containing GTF8487 from *Streptococcus salivarius* CCHSS3 (GI: 340398487; Example 11A), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 40 h, then heated to 90° C. for 30 min to inactivate the enzymes. The resulting product mixture was centrifuged and the resulting supernatant analyzed by HPLC for soluble monosaccharides, disaccharides and oligosaccharides (Table 38), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 38). The combined SEC fractions were diluted to 5 wt % dry solids (DS) and freeze-dried to produce the fiber as a dry solid.

TABLE 38

Soluble oligosaccharide fiber produced by GTF8487/mut3325 mutanase. 450 g/L sucrose, GTF8487, mut3325, 47° C., 40 h

| | Product mixture, g/L | SEC-purified product, g/L | SEC-purified product % (wt/wt DS) |
|---|---|---|---|
| DP7+ | 75.3 | 41.9 | 39.1 |
| DP6 | 33.3 | 19.5 | 18.2 |
| DP5 | 34.8 | 19.7 | 18.4 |
| DP4 | 30.0 | 16.0 | 15.0 |
| DP3 | 13.9 | 6.3 | 5.8 |
| DP2 | 8.2 | 2.1 | 2.0 |
| Sucrose | 10.1 | 0.6 | 0.6 |
| Leucrose | 46.0 | 1.0 | 0.9 |
| Glucose | 6.9 | 0.0 | 0.0 |
| Fructose | 197.8 | 0.0 | 0.0 |
| Sum DP2-DP7+ | 195.5 | 105.5 | 98.5 |
| Sum DP3-DP7+ | 187.3 | 103.4 | 96.5 |

Example 37J

Isolation of Soluble Oligosaccharide Fiber Produced by the Combination of GTF-S Homolog GTF3879 and MUT3325

A 250 mL reaction containing 450 g/L sucrose, *B. subtilis* crude protein extract (15% v/v) containing GTF3879 from *Streptococcus* sp. HSISS4 (GI: 544713879; Example 11A), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 52 h, then heated to 90° C. for 30 min to inactivate the enzymes. The resulting product mixture was centrifuged and the resulting supernatant analyzed by HPLC for soluble monosaccharides, disaccharides and oligosaccharides (Table 39), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 39). The combined SEC fractions were diluted to 5 wt % dry solids (DS) and freeze-dried to produce the fiber as a dry solid.

TABLE 39

Soluble oligosaccharide fiber produce by GTF3879/mut3325 mutanase. 450 g/L sucrose, GTF3879, mut3325, 47° C., 52 h

| | Product mixture, g/L | SEC-purified product, g/L | SEC-purified product % (wt/wt DS) |
|---|---|---|---|
| DP7+ | 31.8 | 23.4 | 22.4 |
| DP6 | 41.3 | 25.6 | 24.4 |
| DP5 | 40.8 | 23.7 | 22.5 |
| DP4 | 36.3 | 19.3 | 18.4 |
| DP3 | 19.9 | 8.8 | 8.4 |
| DP2 | 8.5 | 2.2 | 2.1 |
| Sucrose | 20.8 | 1.1 | 1.1 |
| Leucrose | 37.0 | 0.7 | 0.7 |
| Glucose | 6.8 | 0.0 | 0.0 |
| Fructose | 188.3 | 0.0 | 0.0 |
| Sum DP2-DP7+ | 178.6 | 103.0 | 98.2 |
| Sum DP3-DP7+ | 170.1 | 100.8 | 96.1 |

Example 37K

Isolation of Soluble Oligosaccharide Fiber Produced by the Combination of GTF-S Homolog GTF3808 and MUT3325

A 250 mL reaction containing 450 g/L sucrose, *B. subtilis* crude protein extract (5% v/v) containing GTF3808 from *Streptococcus* sp. SR4 (GI: 573493808; Example 11A), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 22 h, then heated to 90° C. for 30 min to inactivate the enzymes. The resulting product mixture was centrifuged and the resulting supernatant analyzed by HPLC for soluble monosaccharides, disaccharides and oligosaccharides (Table 40), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 40). The combined SEC fractions were diluted to 5 wt % dry solids (DS) and freeze-dried to produce the fiber as a dry solid.

TABLE 40

Soluble oligosaccharide fiber produced by GTF3808/mut3325 mutanase. 450 g/L sucrose, GTF3808, mut3325, 47° C., 22 h

| | Product mixture, g/L | SEC-purified product, g/L | SEC-purified product % (wt/wt DS) |
|---|---|---|---|
| DP7+ | 26.2 | 10.8 | 9.8 |
| DP6 | 31.2 | 19.9 | 18.0 |
| DP5 | 39.0 | 25.9 | 23.5 |
| DP4 | 39.4 | 22.5 | 20.4 |
| DP3 | 27.1 | 10.5 | 9.5 |
| DP2 | 15.5 | 2.4 | 2.2 |
| Sucrose | 15.6 | 0.5 | 0.5 |
| Leucrose | 51.1 | 0.3 | 0.3 |
| Glucose | 6.6 | 0.0 | 0.0 |
| Fructose | 195.1 | 0.0 | 0.0 |
| Sum DP2-DP7+ | 178.4 | 109.3 | 99.2 |
| Sum DP3-DP7+ | 162.9 | 106.9 | 97.0 |

Example 37L

Isolation of Soluble Oligosaccharide Fiber Produced by the Combination of GTF-S Homolog GTF8467 and MUT3325

A 250 mL reaction containing 450 g/L sucrose, *B. subtilis* crude protein extract (5% v/v) containing GTF8467 from *Streptococcus salivarius* NU10 (GI: 660358467; Example 11A), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 47 h, then heated to 90° C. for 30 min to inactivate the enzymes. The resulting product mixture was centrifuged and the resulting supernatant analyzed by HPLC for soluble monosaccharides, disaccharides and oligosaccharides (Table 41), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 41). The combined SEC fractions were diluted to 5 wt % dry solids (DS) and freeze-dried to produce the fiber as a dry solid.

TABLE 41

Soluble oligosaccharide fiber produced by GTF8467/mut3325 mutanase. 450 g/L sucrose, GTF8467, mut3325, 47° C., 47 h

| | Product mixture, g/L | SEC-purified product, g/L | SEC-purified product % (wt/wt DS) |
|---|---|---|---|
| DP7+ | 0.0 | 11.1 | 10.5 |
| DP6 | 57.0 | 20.5 | 19.6 |
| DP5 | 37.8 | 30.1 | 28.7 |
| DP4 | 34.3 | 27.2 | 25.9 |
| DP3 | 20.3 | 12.8 | 12.2 |
| DP2 | 7.5 | 2.5 | 2.4 |
| Sucrose | 69.6 | 0.4 | 0.4 |
| Leucrose | 34.0 | 0.2 | 0.2 |
| Glucose | 6.3 | 0.0 | 0.0 |
| Fructose | 178.3 | 0.0 | 0.0 |
| Sum DP2-DP7+ | 156.8 | 104.1 | 99.5 |
| Sum DP3-DP7+ | 149.3 | 101.6 | 97.1 |

Example 37M

Isolation of Soluble Oligosaccharide Fiber Produced by the Combination of GTF-S Homolog GTF0060 and MUT3325

A 250 mL reaction containing 450 g/L sucrose, *B. subtilis* crude protein extract (5% v/v) containing GTF0060 from *Streptococcus* sp. ACS2 (GI: 576980060; Example 11A), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 47 h, then heated to 90° C. for 30 min to inactivate the enzymes. The resulting product mixture was centrifuged and the resulting supernatant analyzed by HPLC for soluble monosaccharides, disaccharides and oligosaccharides (Table 42), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 42). The combined SEC fractions were diluted to 5 wt % dry solids (DS) and freeze-dried to produce the fiber as a dry solid.

TABLE 42

Soluble oligosaccharide fiber produced by GTF0060/mut3325 mutanase. 450 g/L sucrose, GTF0060, mut3325, 47° C., 47 h

| | Product mixture, g/L | SEC-purified product, g/L | SEC-purified product % (wt/wt DS) |
|---|---|---|---|
| DP7+ | 27.7 | 19.1 | 17.2 |
| DP6 | 41.7 | 28.6 | 27.2 |
| DP5 | 41.9 | 25.8 | 24.5 |
| DP4 | 37.7 | 21.0 | 20.0 |
| DP3 | 22.0 | 9.0 | 8.6 |
| DP2 | 8.4 | 1.9 | 1.8 |
| Sucrose | 23.1 | 0.5 | 0.5 |
| Leucrose | 39.1 | 0.3 | 0.3 |

TABLE 42-continued

Soluble oligosaccharide fiber produced by GTF0060/mut3325 mutanase. 450 g/L sucrose, GTF0060, mut3325, 47° C., 47 h

| | Product mixture, g/L | SEC-purified product, g/L | SEC-purified product % (wt/wt DS) |
|---|---|---|---|
| Glucose | 5.6 | 0.0 | 0.0 |
| Fructose | 198.6 | 0.0 | 0.0 |
| Sum DP2-DP7+ | 179.5 | 104.4 | 99.3 |
| Sum DP3-DP7+ | 171.1 | 102.5 | 97.5 |

Comparative Example 37N

Isolation of Soluble Oligosaccharide Fiber Produced by the Combination of GTF-S and MUT3325

A 250 mL reaction containing 450 g/L sucrose, *B. subtilis* crude protein extract (5% v/v) containing GTF0459 from *Streptococcus* sp. C150 (GI: 495810459; Examples 11A and 11C), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 90 h, then heated to 90° C. for 30 min to inactivate the enzymes. The resulting product mixture was centrifuged and the resulting supernatant analyzed by HPLC for soluble monosaccharides, disaccharides and oligosaccharides (Table 43), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 43). The combined SEC fractions were diluted to 5 wt % dry solids (DS) and freeze-dried to produce the fiber as a dry solid.

TABLE 43

Soluble oligosaccharide fiber produced by GTF0459/mut3325 mutanase. 450 g/L sucrose, GTF0459, mut3325, 47° C., 90 h

| | Product mixture, g/L | SEC-purified product, g/L | SEC-purified product % (wt/wt DS) |
|---|---|---|---|
| DP7+ | 24.2 | 29.0 | 27.0 |
| DP6 | 41.2 | 21.5 | 20.0 |
| DP5 | 45.0 | 24.2 | 22.5 |
| DP4 | 40.8 | 20.5 | 19.0 |
| DP3 | 25.7 | 9.4 | 8.7 |
| DP2 | 10.3 | 2.1 | 1.9 |
| Sucrose | 24.1 | 0.5 | 0.5 |
| Leucrose | 35.9 | 0.4 | 0.3 |
| Glucose | 6.9 | 0.0 | 0.0 |
| Fructose | 198.6 | 0.0 | 0.0 |
| Sum DP2-DP7+ | 197.6 | 106.7 | 99.2 |
| Sum DP3-DP7+ | 187.3 | 104.6 | 97.3 |

Comparative Example 370

Isolation of Soluble Oligosaccharide Fiber Produced by the Combination of GTF-S Non-Homolog GTF0487 and MUT3325

A 250 mL reaction containing 450 g/L sucrose, *B. subtilis* crude protein extract (20% v/v) containing GTF0487 from

*Streptococcus salivarius* PS4 (GI: 495810487; Examples 11A and 11 C), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 214 h, then heated to 90° C. for 30 min to inactivate the enzymes. The resulting product mixture was centrifuged and the resulting supernatant analyzed by HPLC for soluble monosaccharides, disaccharides and oligosaccharides (Table 44), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 44). The combined SEC fractions were diluted to 5 wt % dry solids (DS) and freeze-dried to produce the fiber as a dry solid.

TABLE 44

Soluble oligosaccharide fiber produced by GTF0487/mut3325 mutanase. 450 g/L sucrose, GTF0487, mut0487, 47° C., 214 h

| | Product mixture, g/L | SEC-purified product, g/L | SEC-purified product % (wt/wt DS) |
|---|---|---|---|
| DP7+ | 6.0 | 21.6 | 30.4 |
| DP6 | 3.9 | 10.2 | 14.4 |
| DP5 | 7.9 | 15.9 | 22.3 |
| DP4 | 9.1 | 13.3 | 18.6 |
| DP3 | 8.2 | 6.3 | 8.8 |
| DP2 | 8.6 | 2.4 | 3.3 |
| Sucrose | 96.9 | 0.6 | 0.9 |
| Leucrose | 18.0 | 0.1 | 0.1 |
| Glucose | 94.9 | 0.2 | 0.3 |
| Fructose | 106.0 | 0.7 | 1.0 |
| Sum DP2-DP7+ | 43.7 | 69.7 | 97.8 |
| Sum DP3-DP7+ | 35.1 | 67.3 | 94.5 |

Comparative Example 37P

Isolation of Soluble Oligosaccharide Fiber Produced by the Combination of GTF-S Non-Homolog GTF5360 and MUT3325

A 250 mL reaction containing 450 g/L sucrose, *B. subtilis* crude protein extract (20% v/v) containing GTF5360 from *Streptococcus mutans* JP9-4 (GI: 440355360; Examples 11A and 11C), and *T. reesei* crude protein extract UFC (0.075% v/v) comprising a mutanase from *Penicillium marneffei* ATCC® 18224 (MUT3325, GI:212533325; Example 15) in distilled, deionized $H_2O$, was stirred at pH 5.5 and 47° C. for 214 h, then heated to 90° C. for 30 min to inactivate the enzymes. The resulting product mixture was centrifuged and the resulting supernatant analyzed by HPLC for soluble monosaccharides, disaccharides and oligosaccharides (Table 45), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 45). The combined SEC fractions were diluted to 5 wt % dry solids (DS) and freeze-dried to produce the fiber as a dry solid.

TABLE 45

Soluble oligosaccharide fiber produced by GTF5360/mut3325 mutanase. 450 g/L sucrose, GTF5360, mut3325, 47° C., 214 h

| | Product mixture, g/L | SEC-purified product, g/L | SEC-purified product % (wt/wt DS) |
|---|---|---|---|
| DP7+ | 33.2 | 48.9 | 46.4 |
| DP6 | 15.1 | 17.7 | 16.8 |
| DP5 | 19.2 | 19.9 | 18.9 |
| DP4 | 16.2 | 11.9 | 11.3 |
| DP3 | 11.2 | 5.0 | 4.8 |
| DP2 | 10.7 | 1.8 | 1.7 |
| Sucrose | 29.5 | 0.2 | 0.2 |
| Leucrose | 56.9 | 0.1 | 0.1 |
| Glucose | 53.5 | 0.0 | 0.0 |
| Fructose | 145.9 | 0.0 | 0.0 |
| Sum DP2-DP7+ | 105.5 | 105.3 | 99.8 |
| Sum DP3-DP7+ | 94.8 | 103.5 | 98.1 |

Example 37Q

Isolation of Soluble Oligosaccharide Fiber Produced by the Combination of C-Terminal Truncated GTF0974-T4 and MUT3325

A 250 mL reaction containing 450 g/L sucrose, *B. subtilis* crude protein extract (0.61% v/v) containing a version of GTF0974 from *Streptococcus salivarius* 57.1 (GI: 387760974; Examples 11A and 11C) having additional C terminal truncations of part of the glucan binding domains (GTF0974-T4, Example 11B), and *T. reesei* crude protein extract UFC (0.11% v/v) comprising a mutanase from *Penicillium marneffei* ATCC® 18224 (MUT3325, GI:212533325; Example 15) in distilled, deionized $H_2O$, was stirred at pH 5.5 and 47° C. for 24 h, then heated to 90° C. for 30 min to inactivate the enzymes. The resulting product mixture was centrifuged and the resulting supernatant analyzed by HPLC for soluble monosaccharides, disaccharides and oligosaccharides (Table 46), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 46). The combined SEC fractions were diluted to 5 wt % dry solids (DS) and freeze-dried to produce the fiber as a dry solid.

TABLE 46

Soluble oligosaccharide fiber produced by GTF0974-T4/mut3325 mutanase. 450 g/L sucrose, GTF0974-T4, mut3325, 47° C., 24 h

| | Product mixture, g/L | SEC-purified product, g/L | SEC-purified product % (wt/wt DS) |
|---|---|---|---|
| DP7+ | 47.6 | 29.0 | 26.7 |
| DP6 | 41.7 | 25.5 | 23.5 |
| DP5 | 44.4 | 25.6 | 23.6 |
| DP4 | 41.2 | 19.4 | 17.8 |
| DP3 | 23.8 | 7.5 | 6.9 |
| DP2 | 12.0 | 1.7 | 1.5 |
| Sucrose | 11.0 | 0.0 | 0.0 |
| Leucrose | 42.0 | 0.0 | 0.0 |

TABLE 46-continued

| Soluble oligosaccharide fiber produced by GTF0974-T4/mut3325 mutanase. 450 g/L sucrose, GTF0974-T4, mut3325, 47° C., 24 h | | | |
|---|---|---|---|
| | Product mixture, g/L | SEC-purified product, g/L | SEC-purified product % (wt/wt DS) |
| Glucose | 6.2 | 0.0 | 0.0 |
| Fructose | 200.6 | 0.0 | 0.0 |
| Sum DP2-DP7+ | 210.7 | 108.7 | 100 |
| Sum DP3-DP7+ | 198.7 | 107.0 | 98.5 |

Example 37R

Isolation of Soluble Oligosaccharide Fiber Produced by the Combination of C-Terminal Truncated GTF0974-T5 and MUT3325

A 250 mL reaction containing 450 g/L sucrose, *B. subtilis* crude protein extract (0.51% v/v) containing a version of GTF0974 from *Streptococcus salivarius* 57.1 (GI: 387760974; Examples 11A and 110) having additional C terminal truncations of part of the glucan binding domains (GTF0974-T5, Example 11B), and *T. reesei* crude protein extract UFC (0.11% v/v) comprising a mutanase from *Penicillium marneffei* ATCC® 18224 (MUT3325, GI:212533325, Example 15) in distilled, deionized $H_2O$, was stirred at pH 5.5 and 47° C. for 24 h, then heated to 90° C. for 30 min to inactivate the enzymes. The resulting product mixture was centrifuged and the resulting supernatant analyzed by HPLC for soluble monosaccharides, disaccharides and oligosaccharides (Table 47), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 47). The combined SEC fractions were diluted to 5 wt % dry solids (DS) and freeze-dried to produce the fiber as a dry solid.

TABLE 47

| Soluble oligosaccharide fiber produced by GTF0974-T5/mut3325 mutanase. 450 g/L sucrose, GTF0974-T5, mut3325, 47° C., 24 h | | | |
|---|---|---|---|
| | Product mixture, g/L | SEC-purified product, g/L | SEC-purified product % (wt/wt DS) |
| DP7+ | 41.0 | 23.9 | 22.2 |
| DP6 | 42.7 | 26.9 | 25.0 |
| DP5 | 44.5 | 27.2 | 25.2 |
| DP4 | 40.3 | 20.6 | 19.1 |
| DP3 | 24.2 | 7.9 | 7.3 |
| DP2 | 11.5 | 1.3 | 1.2 |
| Sucrose | 12.3 | 0.0 | 0.0 |
| Leucrose | 42.0 | 0.0 | 0.0 |
| Glucose | 6.0 | 0.0 | 0.0 |
| Fructose | 201.9 | 0.0 | 0.0 |
| Sum DP2-DP7+ | 204.2 | 107.8 | 100 |
| Sum DP3-DP7+ | 192.7 | 106.5 | 98.8 |

Example 37S

Isolation of Soluble Oligosaccharide Fiber Produced by the Combination of C-Terminal Truncated GTF3808-T5 and MUT3325

A 250 mL reaction containing 450 g/L sucrose, *B. subtilis* crude protein extract (0.77% v/v) containing a version of GTF3808 from *Streptococcus* sp. SR4 (GI: 573493808; Examples 11A and 11C) having additional C terminal truncations of part of the glucan binding domains (GTF3808-T5, Example 11B), and *T. reesei* crude protein extract UFC (0.11% v/v) comprising a mutanase from *Penicillium marneffei* ATCC® 18224 (MUT3325, GI:212533325, Example 15) in distilled, deionized $H_2O$, was stirred at pH 5.5 and 47° C. for 19 h, then heated to 90° C. for 30 min to inactivate the enzymes. The resulting product mixture was centrifuged and the resulting supernatant analyzed by HPLC for soluble monosaccharides, disaccharides and oligosaccharides (Table 48), then the oligosaccharides were isolated from the supernatant by SEC at 40° C. using Diaion UBK 530 (Na+ form) resin (Mitsubishi). The SEC fractions that contained oligosaccharides DP3 were combined and concentrated by rotary evaporation for analysis by HPLC (Table 48). The combined SEC fractions were diluted to 5 wt % dry solids (DS) and freeze-dried to produce the fiber as a dry solid.

TABLE 48

| Soluble oligosaccharide fiber produced by GTF3808-T5/mut3325 mutanase. 450 g/L sucrose, GTF3808-T5, mut3325, 47° C., 19 h | | | |
|---|---|---|---|
| | Product mixture, g/L | SEC-purified product, g/L | SEC-purified product % (wt/wt DS) |
| DP7+ | 55.7 | 29.2 | 26.5 |
| DP6 | 38.7 | 23.8 | 21.7 |
| DP5 | 42.4 | 25.1 | 22.9 |
| DP4 | 39.3 | 20.5 | 18.7 |
| DP3 | 21.5 | 8.1 | 7.4 |
| DP2 | 11.8 | 1.6 | 1.5 |
| Sucrose | 10.9 | 0.5 | 0.5 |
| Leucrose | 41.6 | 0.1 | 0.1 |
| Glucose | 6.3 | 0.0 | 0.0 |
| Fructose | 196.1 | 0.0 | 0.0 |
| Sum DP2-DP7+ | 209.3 | 108.3 | 99.4 |
| Sum DP3-DP7+ | 197.6 | 106.7 | 97.9 |

Example 38

Anomeric Linkage Analysis of Soluble Oligosaccharide Fiber Produced by GTF-J and by GTF/Mutanase Combinations Solutions of chromatographically-purified soluble oligosaccharide oligomer/polymers prepared as described in Examples 30 to Example 37 were dried to a constant weight by lyophilization, and the resulting solids analyzed by $^1H$ NMR spectroscopy and by GC/MS as described in the General Methods section (above). The anomeric linkages for each of these soluble oligosaccharide oligomer/polymer mixtures are reported in Tables 49 and 50.

TABLE 49

| Anomeric linkage analysis of soluble oligosaccharides by $^1$H NMR spectroscopy. | | | | | |
|---|---|---|---|---|---|
| Example # | GTF/mutanase | % α-(1, 3) | % α-(1, 3, 6) | % α-(1, 2, 6) | % α-(1, 6) |
| 30 | GTF 7527/mut3264 | 89.6 | 1.8 | 0.0 | 8.6 |
| 31 | GTF 2379/mut3264 | 60.2 | 3.3 | 0.0 | 36.6 |
| 32 | GTF 7527/mut3325 | 95.2 | 2.0 | 0.0 | 2.8 |
| 33 | GTF 0874/mut3325 | 75.2 | 0.0 | 0.0 | 24.8 |
| 34 | GTF 0459/mut3264 | 88.2 | 5.7 | 0.0 | 6.1 |
| 35 | GTF 0544/mut3264 | 15.0 | 3.4 | 0.0 | 81.6 |
| 36 | GTF 0459/mut3325 | 88.9 | 5.7 | 0.0 | 5.4 |
| 37 | GTF 7527/no mutanase | 74.6 | 9.8 | 0.0 | 15.6 |

TABLE 50

| Anomeric linkage analysis of soluble oligosaccharides by GC/MS. | | | | | | | | | | |
|---|---|---|---|---|---|---|---|---|---|---|
| Example # | GTF/mutanase | % α-(1, 4) | % α-(1, 3) | % α-(1, 3, 6) | % 2, 1 Fruc | % α-(1, 2) | % α-(1, 6) | % α-(1, 3, 4) | % α-(1, 2, 3) | % α-(1, 4, 6) + α-(1, 2, 6) |
| 32 | GTF 7527/mut3325 | 0.4 | 97.1 | 0.6 | 0.0 | 0.6 | 0.9 | 0.1 | 0.2 | 0.1 |
| 34 | GTF 0459/mut3264 | 0.4 | 96.9 | 1.4 | 0.0 | 0.2 | 0.7 | 0.1 | 0.2 | 0.0 |
| 35 | GTF 0544/mut3264 | 0.4 | 24.1 | 2.5 | 1.0 | 0.5 | 70.9 | 0.0 | 0.0 | 0.6 |
| 36 | GTF 0459/mut3325 | 0.5 | 95.0 | 1.7 | 1.1 | 0.5 | 0.9 | 0.0 | 0.0 | 0.2 |
| 37 | GTF7527/no mutanase | 0.9 | 90.8 | 2.2 | 0.0 | 0.4 | 5.0 | 0.1 | 0.4 | 0.2 |

Example 39

Viscosity of Soluble Oligosaccharide Fiber Produced by GTF-J and by GTF/Mutanase Combinations Solutions of chromatographically-purified soluble oligosaccharide oligomer/polymers prepared as described in various Examples were dried to a constant weight by lyophilization, and the resulting solids were used to prepare a 12 wt % solution of soluble oligomer/polymer in distilled, deionized water. The viscosity of the soluble oligomer/polymer solutions (reported in centipoise (cP), where 1 cP=1 millipascal-s (mPa-s)) (Table 51) was measured at 20° C. as described in the General Methods section.

TABLE 51

| Viscosity of 12% (w/w) soluble oligosaccharide oligomer/polymer solutions measured at 20° C. | | |
|---|---|---|
| Example # | GTF/mutanase | viscosity (cP) |
| 19 | GTF7527/mut3264 | 1.4 |
| 21 | GTF2379/mut3264 | ND |
| 20 | GTF7527/mut3325 | 2.0 |
| 24 | GTF0874/mut3325 | 1.6 |
| 29 | GTF0459/mut3264 | 1.7 |
| 22 | GTF0544/mut3264 | 6.7 |
| 36 | GTF0459/mut3325 | 1.8 |
| 37 | GTF7527/no mutanase | ND |

(ND = not determined)

Example 40

Preparation of Extracts of Glucosyltransferase (GTF) Enzymes for Fiber Production at Different Temperatures The *Streptococcus salivarius* gtfJ enzyme (SEQ ID NO: 5) used in Examples 1 and 2 was expressed in *E. coli* strain DH10B using an isopropyl beta-D-1-thiogalactopyranoside (IPTG)-induced expression system. Briefly, *E. coli* DH10B cells were transformed to express SEQ ID NO: 5 from a DNA sequence (SEQ ID NO:4) codon-optimized to express the gtfJ enzyme in *E. coli*. This DNA sequence was contained in the expression vector, PJEXPRESS404® (DNA 2.0, Menlo Park CA). The transformed cells were inoculated to an initial optical density (OD at 600 nm) of 0.025 in LB medium (10 g/L Tryptone; 5 g/L yeast extract, 10 g/L NaCl) and allowed to grow at 37° C. in an incubator while shaking at 250 rpm. The cultures were induced by addition of 1 mM IPTG when they reached an $OD_{600}$ of 0.8-1.0. Induced cultures were left on the shaker and harvested 3 hours post induction.

For harvesting gtfJ enzyme (SEQ ID NO: 5), the cells were centrifuged (25° C., 16,000 rpm) in an EPPENDORF® centrifuge, resuspended in 5.0 mM phosphate buffer (pH 7.0) and cooled to 4° C. on ice. The cells were broken using a bead beater with 0.1 mm silica beads, and then centrifuged at 16,000 rpm at 4° C. to pellet the unbroken cells and cell debris. The crude extract (containing soluble gtfJ enzyme, SEQ ID NO: 5) was separated from the pellet and analyzed by Bradford protein assay to determine protein concentration (mg/mL).

The additional gtf enzymes used in Example 41 were prepared as follows. *E. coli* TOP10® cells (Invitrogen, Carlsbad California) were transformed with a PJEXPRESS404®-based construct containing a particular gtf-encoding DNA sequence. Each sequence was codon-optimized to express the gtf enzyme in *E. coli*. Individual *E. coli* strains expressing a particular gtf enzyme were grown in LB medium with ampicillin (100 mg/mL) at 37° C. with shaking to $OD_{600}$=0.4-0.5, at which time IPTG was added to a final concentration of 0.5 mM. The cultures were incubated for 2-4 hours at 37° C. following IPTG induction. Cells were harvested by centrifugation at 5,000×g for 15 minutes and resuspended (20% w/v) in 50 mM phosphate buffer pH 7.0 supplemented with DTT (1.0 mM). Resuspended cells were passed through a French Pressure Cell (SLM Instruments, Rochester, NY) twice to ensure >95% cell lysis. Lysed cells were centrifuged for 30 minutes at 12,000×g at 4° C. The resulting supernatant was analyzed by the BCA protein assay and SDS-PAGE to confirm expression of the gtf enzyme, and the supernatant was stored at −20° C.

Analysis of Reaction Profiles

Periodic samples from reaction mixtures were taken and analyzed using an Agilent 1260C HPLC equipped with a refractive index detector. An Aminex HP-87C column, (Bio-Rad) using deionized water at a flow rate of 0.6 mL/min and 85° C. was used to monitor sucrose and glucose. An Aminex HP-42A column (BioRad) using deionized water at a flow rate of 0.6 mL/min and 85° C. was used to quantitate oligosaccharides from DP2-DP7 which were previously calibrated using malto oligosaccharides.

Example 41

Oligosaccharide Production Using GTF-J at Various Temperatures

The desired amount of sucrose, in some cases glucose, and 20 mM dihydrogen potassium phosphate were dissolved using deionized water and diluted to 750 mL in a 1 L unbaffled jacketed flask that was connected to a Lauda RK20 recirculating chiller. FERMASURE™ (DuPont, Wilmington, DE) was then added (0.5 mL/L reaction), and the pH was adjusted to 5.5 using 5 wt % aqueous sodium hydroxide or 5 wt % aqueous sulfuric acid. The reaction was initiated by the addition of 0.3 vol % of crude enzyme extract (SEQ ID NO: 5) as described in Example 40. Agitation to the reaction mixture was provided using a 4-blade PTFE overhead mechanical mixer at 100 rpm. After the reaction was determined to be complete by either complete consumption of sucrose or no change in sucrose concentration between subsequent measurements, the reaction slurry was filtered to remove the insoluble polymer. Yields of the soluble oligosaccharides were determined by HPLC according to the method in Example 40 and are presented in Table 52.

TABLE 52

Yield of oligosaccharides using gtf-J under various operating conditions.

| T (° C.) | Glucose (g/L, t = 0) | Sucrose (g/L, t = 0) | % sucrose converted | g oligomers/ g sucrose reacted | g leucrose/ g sucrose reacted |
|---|---|---|---|---|---|
| 25 | 0 | 94.9 | 95 | 0.12 | 0.32 |
| 25 | 25.2 | 100.4 | 93 | 0.30 | 0.21 |
| 25 | 0 | 407.9 | 96 | 0.20 | 0.56 |
| 42 | 0 | 94.5 | 99 | 0.13 | 0.26 |
| 47 | 0 | 95.0 | 90 | 0.25 | 0.35 |
| 47 | 25.7 | 101.1 | 92 | 0.39 | 0.15 |
| 47 | 103.4 | 102.1 | 81 | 0.65 | 0.09 |
| 47 | 26.6 | 255.7 | 94 | 0.26 | 0.23 |
| 47 | 105.2 | 408.4 | 91 | 0.47 | 0.26 |
| 47 | 27.6 | 415.3 | 94 | 0.29 | 0.33 |

These results demonstrate that the yield of soluble oligosaccharides is increased when the reaction is run above 42° C., that the yield of oligosaccharides can be further increased by adding an acceptor molecule, such as glucose, and that the amount of leucrose formed decreases upon addition of an acceptor molecule.

Example 42

Oligosaccharide Production Using Other GTF Enzymes

The desired amount of sucrose and 20 mM dihydrogen potassium phosphate were dissolved using deionized water and transferred to a glass bottle equipped with a polypropylene cap. Fermasure™ (DuPont, Wilmington, DE) was then added (0.5 mL/L reaction), and the pH was adjusted to 5.5 using 5 wt % aqueous sodium hydroxide or 5 wt % aqueous sulfuric acid. The reaction was initiated by the addition of crude enzyme extract as prepared in Example 41. Additional truncated GTFs from the following were tested: *Streptococcus sobrinus* (GTF0874; SEQ ID NO: 16), *Streptococcus downei* (GTF1724; SEQ ID NO: 81), and *Streptococcus dentirousetti* (GTF5926; SEQ ID NO: 84). Agitation to the reaction mixture was provided using either a PTFE stirbar or an Inova 42 incubator shaker, and the reaction was heated either using a block heater or the incubator shaker. After the reaction was determined to be complete by either complete consumption of sucrose or no change in sucrose concentration between subsequent measurements, the reaction slurry was filtered to remove the insoluble polymer. Yield of the soluble oligosaccharides was determined by HPLC according to the method in Example 41 and are presented in Table 53.

TABLE 53

Comparison of oligomer yield using gtf enzymes under various operating conditions.

| Scale (mL) | SEQ ID NO | T (° C.) | Sucrose (g/L, t = 0) | % sucrose converted | g oligomer/ g sucrose reacted | g leucrose/ g sucrose reacted |
|---|---|---|---|---|---|---|
| 100 | SEQ ID NO: 16 | 37 | 146.0 | 97 | 0.24 | 0.39 |
| 10 | SEQ ID NO: 16 | 50 | 149.1 | 95 | 0.30 | 0.24 |
| 100 | SEQ ID NO: 81 | 37 | 146.1 | 99 | 0.25 | 0.33 |
| 10 | SEQ ID NO: 81 | 50 | 149.1 | 99 | 0.33 | 0.24 |
| 100 | SEQ ID NO: 84 | 37 | 145.8 | 74 | 0.21 | 0.29 |
| 10 | SEQ ID NO: 84 | 50 | 149.1 | 99 | 0.30 | 0.28 |

These results demonstrate that behavior described in Example 41 is general to other gtf enzymes.

Example 43

Preparation of a Sodium Carboxymethyl α-Glucan

This Example describes producing the glucan ether derivative, carboxymethyl glucan, using the α-glucan oligomer/polymer composition described herein.

Approximately 1 g of an α-glucan oligomer/polymer composition as described in Examples 30, 32, 33, 34, 36 and 37 is added to 20 mL of isopropanol in a 50-mL capacity round bottom flask fitted with a thermocouple for temperature monitoring and a condenser connected to a recirculating bath, and a magnetic stir bar. Sodium hydroxide (4 mL of a 15% solution) is added drop wise to the preparation, which is then heated to 25° C. on a hotplate. The preparation is stirred for 1 hour before the temperature is increased to 55° C. Sodium monochloroacetate (0.3 g) is then added to provide a reaction, which is held at 55° C. for 3 hours before being neutralized with glacial acetic acid. The material is then collected and analyzed by NMR to determine degree of substitution (DoS) of the solid.

Various DoS samples of carboxymethyl α-glucan are prepared using processes similar to the above process, but with certain modifications such as the use of different reagent (sodium monochloroacetate): α-glucan oligomer/polymer molar ratios, different NaOH:α-glucan oligomer/polymer molar ratios, different temperatures, and/or reaction times.

Example 44

Viscosity Modification Using Carboxymethyl α-Glucan

This Example describes the effect of carboxymethyl α-glucan on the viscosity of an aqueous composition.

Various sodium carboxymethyl glucan samples as prepared in Example 43 are tested. To prepare 0.6 wt % solutions of each of these samples, 0.102 g of sodium carboxymethyl α-glucan is added to DI water (17 g). Each preparation is then mixed using a bench top vortexer at 1000 rpm until completely dissolved.

To determine the viscosity of carboxymethyl α-glucan, each solution of the dissolved α-glucan ether samples is subjected to various shear rates using a Brookfield III+ viscometer equipped with a recirculating bath to control temperature (20° C.). The shear rate is increased using a gradient program which increased from 0.1-232.5 rpm and the shear rate is increased by 4.55 (1/s) every 20 seconds.

Example 45

Preparation of Carboxymethyl Dextran from Solid Dextran

This Example describes producing carboxymethyl dextran for use in Example 46.

Approximately 0.5 g of solid dextran ($M_w$=750000) was added to 10 mL of isopropanol in a 50-mL capacity round bottom flask fitted with a thermocouple for temperature monitoring and a condenser connected to a recirculating bath, and a magnetic stir bar. Sodium hydroxide (0.9 mL of a 15% solution) was added drop wise to the preparation, which was then heated to 25° C. on a hotplate. The preparation was stirred for 1 hour before the temperature was increased to 55° C. Sodium monochloroacetate (0.15 g) was then added to provide a reaction, which was held at 55° C. for 3 hours before being neutralized with glacial acetic acid. The solid material was then collected by vacuum filtration and washed with ethanol (70%) four times, dried under vacuum at 20-25° C., and analyzed by NMR to determine degree of substitution (DoS) of the solid. The solid was identified as sodium carboxymethyl dextran.

Additional sodium carboxymethyl dextran was prepared using dextran of different M. The DoS values of carboxymethyl dextran samples prepared in this example are provided in Table 54.

TABLE 54

Samples of Sodium Carboxymethyl Dextran Prepared from Solid Dextran

| Product Sample Designation | Dextran $M_w$ | Reagent[a]:Dextran Molar Ratio[b] | NaOH:Dextran Molar Ratio[b] | Reaction Time (hours) | DoS |
|---|---|---|---|---|---|
| 2A | 750000 | 0.41 | 1.08 | 3 | 0.64 |
| 2B | 1750000 | 0.41 | 0.41 | 3 | 0.49 |

[a]Reagent refers to sodium monochloroacetate.

[b]Molar ratios calculated as moles of reagent per moles of dextran (third column), or moles of NaOH per moles of dextran (fourth column).

These carboxymethyl dextran samples were tested for their viscosity modification effects in Example 46.

Example 46 (Comparative)

Effect of Shear Rate on Viscosity of Carboxymethyl Dextran

This Example describes the viscosity, and the effect of shear rate on viscosity, of solutions containing the carboxymethyl dextran samples prepared in Example 46.

Various sodium carboxymethyl dextran samples (2A and 2B) were prepared as described in Example 45. To prepare 0.6 wt % solutions of each of these samples, 0.102 g of sodium carboxymethyl dextran was added to DI water (17 g). Each preparation was then mixed using a bench top vortexer at 1000 rpm until the solid was completely dissolved.

To determine the viscosity of carboxymethyl dextran at various shear rates, each solution of the dissolved dextran ether samples was subjected to various shear rates using a Brookfield III+ viscometer equipped with a recirculating bath to control temperature (20° C.). The shear rate was increased using a gradient program which increased from 0.1-232.5 rpm and the shear rate was increased by 4.55 (1/s) every 20 seconds. The results of this experiment at 14.72 (1/s) are listed in Table 55.

TABLE 55

Viscosity of Carboxymethyl Dextran Solutions at Various Shear Rates

| Sample | Sample Loading (wt %) | Viscosity (cPs) @ 66.18 rpm | Viscosity (cPs) @ 110.3 rpm | Viscosity (cPs) @ 183.8 rpm | Viscosity (cPs) @ 250 rpm |
|---|---|---|---|---|---|
| 2A | 0.6 | 4.97 | 2.55 | 4.43 | 3.88 |
| 2B | 0.6 | 6.86 | 5.68 | 5.28 | 5.26 |

The results summarized in Table 55 indicate that 0.6 wt % solutions of carboxymethyl dextran have viscosities of about 2.5-7 cPs.

Example 47 (Comparative)

Preparation of Carboxymethyl α-Glucan

This Example describes producing carboxymethyl glucan for use in Example 48.

The glucan was prepared as described in Examples 30, 32, 33, 34, 36 or 37.

Approximately 150 g of the α-glucan oligomer/polymer composition is added to 3000 mL of isopropanol in a 500-mL capacity round bottom flask fitted with a thermocouple for temperature monitoring and a condenser connected to a recirculating bath, and a magnetic stir bar. Sodium hydroxide (600 mL of a 15% solution) is added drop wise to the preparation, which is then heated to 25° C. on a hotplate. The preparation is stirred for 1 hour before the temperature is increased to 55° C. Sodium monochloroacetate is then added to provide a reaction, which is held at 55° C. for 3 hours before being neutralized with 90% acetic acid. The material is then collected and analyzed by NMR to determine degree of substitution (DoS).

Various DoS samples of carboxymethyl α-glucan are prepared using processes similar to the above process, but with certain modifications such as the use of different reagent (sodium monochloroacetate):α-glucan oligomer/polymer molar ratios, different NaOH:α-glucan oligomer/polymer molar ratios, different temperatures, and/or reaction times.

Example 48 (Comparative)

Viscosity Modification Using Carboxymethyl α-Glucan

This Example describes the effect of carboxymethyl α-glucan on the viscosity of an aqueous composition.

Various sodium carboxymethyl glucan samples are prepared as described in Example 47. To prepare 0.6 wt % solutions of each of these samples, 0.102 g of sodium carboxymethyl α-glucan is added to DI water (17 g). Each preparation is then mixed using a bench top vortexer at 1000 rpm until completely dissolved.

To determine the viscosity of carboxymethyl glucan at various shear rates, each solution of the glucan ether samples is subjected to various shear rates using a Brookfield III+ viscometer equipped with a recirculating bath to control temperature (20° C.). The shear rate is increased using a gradient program which increased from 0.1-232.5 rpm and then the shear rate is increased by 4.55 (1/s) every 20 seconds.

Example 49 (Comparative)

Viscosity Modification Using Carboxymethyl Cellulose

This Example describes the effect of carboxymethyl cellulose (CMC) on the viscosity of an aqueous composition.

CMC samples obtained from DuPont Nutrition & Health (Danisco) were dissolved in DI water to prepare 0.6 wt % solutions of each sample.

To determine the viscosity of CMC at various shear rates, each solution of the dissolved CMC samples was subjected to various shear rates using a Brookfield III+ viscometer equipped with a recirculating bath to control temperature (20° C.). The shear rate was increased using a gradient program which increased from 0.1-232.5 rpm and the shear rate was increased by 4.55 (1/s) every 20 seconds. Results of this experiment at 14.72 (1/s) are listed in Table 56.

TABLE 56

Viscosity of CMC Solutions

| Sample | Molecular Weight (Mw) | DoS | Sample Loading (wt %) | Viscosity (cPs) @ 14.9 rpm |
|---|---|---|---|---|
| C3A (BAK 130) | ~130000 | 0.66 | 0.6 | 235.03 |
| C3B (BAK 550) | ~550000 | 0.734 | 0.6 | 804.31 |

CMC (0.6 wt %) therefore can increase the viscosity of an aqueous solution.

Example 50

Creating Calibration Curves for Direct Red 80 and Toluidine Blue O Dyes Using UV Absorption This example discloses creating calibration curves that could be useful for determining the relative level of adsorption of glucan ether derivatives onto fabric surfaces.

Solutions of known concentration (ppm) are made using Direct Red 80 and Toluidine Blue O dyes. The absorbance of these solutions are measured using a LAMOTTE SMART2 Colorimeter at either 520 nm (Direct Red 80) or 620 nm (Toluidine Blue O Dye). The absorption information is plotted in order that it can be used to determine dye concentration of solutions exposed to fabric samples. The concentration and absorbance of each calibration curve are provided in Tables 57 and 58.

TABLE 57

Direct Red 80 Dye Calibration Curve Data

| Dye Concentration (ppm) | Average Absorbance @520 nm |
|---|---|
| 25 | 0.823333333 |
| 22.5 | 0.796666667 |
| 20 | 0.666666667 |
| 15 | 0.51 |
| 10 | 0.37 |
| 5 | 0.2 |

TABLE 58

Toluidine Blue O Dye Calibration Curve Data

| Dye Concentration (ppm) | Average Absorbance @620 nm |
|---|---|
| 12.5 | 1.41 |
| 10 | 1.226666667 |
| 7 | 0.88 |
| 5 | 0.676666667 |
| 3 | 0.44 |
| 1 | 0.166666667 |

Thus, calibration curves were prepared that are useful for determining the relative level of adsorption of poly alpha-1,3-glucan ether derivatives onto fabric surfaces.

Example 51

Preparation of Quaternary Ammonium Glucan

This Example describes how one could produce a quaternary ammonium glucan ether derivative. Specifically, trimethylammonium hydroxypropyl glucan can be produced.

Approximately 10 g of the α-glucan oligomer/polymer composition (prepared as in Examples 30, 32, 33, 34, 36, or 37) is added to 100 mL of isopropanol in a 500-mL capacity round bottom flask fitted with a thermocouple for temperature monitoring and a condenser connected to a recirculating bath, and a magnetic stir bar. 30 mL of sodium hydroxide (17.5% solution) is added drop wise to this preparation, which is then heated to 25° C. on a hotplate. The preparation is stirred for 1 hour before the temperature is increased to 55° C. 3-chloro-2-hydroxypropyl-trimethylammonium chloride (31.25 g) is then added to provide a reaction, which is held at 55° C. for 1.5 hours before being neutralized with 90% acetic acid. The product that forms (trimethylammonium hydroxypropyl glucan) is collected by vacuum filtration and washed with ethanol (95%) four times, dried under vacuum at 20-25° C., and analyzed by NMR and SEC to determine molecular weight and DoS.

Thus, the quaternary ammonium glucan ether derivative, trimethylammonium hydroxypropyl glucan, can be prepared and isolated.

Example 52

Effect of Shear Rate on Viscosity of Quaternary Ammonium Glucan

This Example describes how one could test the effect of shear rate on the viscosity of trimethylammonium hydroxypropyl glucan as prepared in Example 51. It is contemplated that this glucan ether derivative exhibits shear thinning or shear thickening behavior.

Samples of trimethylammonium hydroxypropyl glucan are prepared as described in Example 51. To prepare a 2 wt % solution of each sample, 1 g of sample is added to 49 g of DI water. Each preparation is then homogenized for 12-15 seconds at 20,000 rpm to dissolve the trimethylammonium hydroxypropyl glucan sample in the water.

To determine the viscosity of each 2 wt % quaternary ammonium glucan solution at various shear rates, each solution is subjected to various shear rates using a Brookfield DV III+ Rheometer equipped with a recirculating bath to control temperature (20° C.) and a ULA (ultra low adapter) spindle and adapter set. The shear rate is increased using a gradient program which increases from 10-250 rpm and the shear rate is increased by 4.9 1/s every 20 seconds for the ULA spindle and adapter.

It is contemplated that the viscosity of each of the quaternary ammonium glucan solutions would change (reduced or increased) as the shear rate is increased, thereby indicating that the solutions demonstrate shear thinning or shear thickening behavior. Such would indicate that quaternary ammonium glucan could be added to an aqueous liquid to modify its rheological profile.

Example 53

Adsorption of Quaternary Ammonium Glucan on Various Fabrics

This example discloses how one could test the degree of adsorption of a quaternary ammonium glucan (trimethylammonium hydroxypropyl glucan) on different types of fabrics.

A 0.07 wt % solution of trimethylammonium hydroxypropyl glucan (as prepared in Example 51) is made by dissolving 0.105 g of the polymer in 149.89 g of deionized water. This solution is divided into several aliquots with different concentrations of polymer (Table 59). Other components are added such as acid (dilute hydrochloric acid) or base (sodium hydroxide) to modify pH, or NaCl salt.

TABLE 59

Quaternary Ammonium Glucan Solutions Useful in Fabric Adsorotion Studies

| Amount of Solution (g) | Polymer Concentration (wt %) | Final pH |
|---|---|---|
| 15 | 0.07 | ~7 |
| 14.85 | 0.0693 | ~7 |
| 14.7 | 0.0686 | ~7 |
| 14.55 | 0.0679 | ~7 |
| 9.7713 | 0.0683 | ~3 |
| 9.7724 | 0.0684 | ~5 |
| 10.0311 | 0.0702 | ~9 |
| 9.9057 | 0.0693 | ~11 |

Four different fabric types (cretonne, polyester, 65:35 polyester/cretonne, bleached cotton) are cut into 0.17 g pieces. Each piece is placed in a 2-m L well in a 48-well cell culture plate. Each fabric sample is exposed to 1 mL of each of the above solutions (Table 59) for a total of 36 samples (a control solution with no polymer is included for each fabric test). The fabric samples are allowed to sit for at least 30 minutes in the polymer solutions. The fabric samples are removed from the polymer solutions and rinsed in DI water for at least one minute to remove any unbound polymer. The fabric samples are then dried at 60° C. for at least 30 minutes until constant dryness is achieved. The fabric samples are weighed after drying and individually placed in 2-mL wells in a clean 48-well cell culture plate. The fabric samples are then exposed to 1 mL of a 250 ppm Direct Red 80 dye solution. The samples are left in the dye solution for at least 15 minutes. Each fabric sample is removed from the dye solution, after which the dye solution is diluted 10×.

The absorbance of the diluted solutions is measured compared to a control sample. A relative measure of glucan polymer adsorbed to the fabric is calculated based on the calibration curve created in Example 50 for Direct Red 80 dye. Specifically, the difference in UV absorbance for the fabric samples exposed to polymer compared to the controls (fabric not exposed to polymer) represents a relative measure of polymer adsorbed to the fabric. This difference in UV absorbance could also be expressed as the amount of dye bound to the fabric (over the amount of dye bound to control), which is calculated using the calibration curve (i.e., UV absorbance is converted to ppm dye). A positive value represents the dye amount that is in excess to the dye amount bound to the control fabric, whereas a negative value represents the dye amount that is less than the dye amount bound to the control fabric. A positive value would reflect that the glucan ether compound adsorbed to the fabric surface.

It is believed that this assay would demonstrate that quaternary ammonium glucan can adsorb to various types of fabric under different salt and pH conditions. This adsorption would suggest that cationic glucan ether derivatives are useful in detergents for fabric care (e.g., as anti-redeposition agents).

Example 54

Adsorption of the Present α-Glucan Fiber Compositions on Various Fabrics

This example discloses how one could test the degree of adsorption of the present α-glucan oligomer/polymer composition (unmodified) on different types of fabrics.

A 0.07 wt % solution of the present α-glucan oligomer/polymer composition (as prepared in Examples 30, 32, 33, 34, 36 or 37) is made by dissolving 0.105 g of the polymer in 149.89 g of deionized water. This solution is divided into several aliquots with different concentrations of polymer (Table 60). Other components are added such as acid (dilute hydrochloric acid) or base (sodium hydroxide) to modify pH, or NaCl salt.

TABLE 60

α-Glucan Fiber Solutions Useful in Fabric Adsorption Studies

| Amount of NaCl (g) | Amount of Solution (g) | Polymer Concentration (wt %) | Final pH |
|---|---|---|---|
| 0 | 15 | 0.07 | ~7 |
| 0.15 | 14.85 | 0.0693 | ~7 |
| 0.3 | 14.7 | 0.0686 | ~7 |
| 0.45 | 14.55 | 0.0679 | ~7 |
| 0 | 9.7713 | 0.0683 | ~3 |
| 0 | 9.7724 | 0.0684 | ~5 |
| 0 | 10.0311 | 0.0702 | ~9 |
| 0 | 9.9057 | 0.0693 | ~11 |

Four different fabric types (cretonne, polyester, 65:35 polyester/cretonne, bleached cotton) are cut into 0.17 g pieces. Each piece is placed in a 2-m L well in a 48-well cell culture plate. Each fabric sample is exposed to 1 mL of each of the above solutions (Table 60) for a total of 36 samples (a control solution with no polymer is included for each fabric test). The fabric samples are allowed to sit for at least 30 minutes in the polymer solutions. The fabric samples are removed from the polymer solutions and rinsed in DI water for at least one minute to remove any unbound polymer. The fabric samples are then dried at 60° C. for at least 30 minutes until constant dryness is achieved. The fabric samples are weighed after drying and individually placed in 2-mL wells in a clean 48-well cell culture plate. The fabric samples are then exposed to 1 mL of a 250 ppm Direct Red 80 dye solution. The samples are left in the dye solution for at least 15 minutes. Each fabric sample is removed from the dye solution, after which the dye solution is diluted 10×.

The absorbance of the diluted solutions is measured compared to a control sample. A relative measure of the α-glucan polymer adsorbed to the fabric is calculated based on the calibration curve created in Example 50 for Direct Red 80 dye. Specifically, the difference in UV absorbance for the fabric samples exposed to polymer compared to the controls (fabric not exposed to polymer) represents a relative measure of polymer adsorbed to the fabric. This difference in UV absorbance could also be expressed as the amount of dye bound to the fabric (over the amount of dye bound to control), which is calculated using the calibration curve (i.e., UV absorbance is converted to ppm dye). A positive value represents the dye amount that is in excess to the dye amount bound to the control fabric, whereas a negative value represents the dye amount that is less than the dye amount bound to the control fabric. A positive value would reflect that the glucan ether compound adsorbed to the fabric surface.

It is believed that this assay would demonstrate that the present α-glucan oligomer/polymer compositions can adsorb to various types of fabric under different salt and pH conditions. This adsorption would suggest that the present α-glucan oligomer/polymer compositions are useful in detergents for fabric care (e.g., as anti-redeposition agents).

Example 55

Adsorption of Carboxymethyl α-Glucan (CMG) on Various Fabrics

This example discloses how one could test the degree of adsorption of an α-glucan ether compound (CMG) on different types of fabrics.

A 0.25 wt % solution of CMG is made by dissolving 0.375 g of the polymer in 149.625 g of deionized water. This solution is divided into several aliquots with different concentrations of polymer (Table 61). Other components are added such as acid (dilute hydrochloric acid) or base (sodium hydroxide) to modify pH, or NaCl salt.

TABLE 61

CMG Solutions Useful in Fabric Adsorption Studies

| Amount of NaCl (g) | Amount of Solution (g) | Polymer Concentration (wt %) | Final pH |
|---|---|---|---|
| 0 | 15 | 0.25 | ~7 |
| 0.15 | 14.85 | 0.2475 | ~7 |
| 0.3 | 14.7 | 0.245 | ~7 |
| 0.45 | 14.55 | 0.2425 | ~7 |
| 0 | 9.8412 | 0.2459 | ~3 |
| 0 | 9.4965 | 0.2362 | ~5 |
| 0 | 9.518 | 0.2319 | ~9 |
| 0 | 9.8811 | 0.247 | ~11 |

Four different fabric types (cretonne, polyester, 65:35 polyester/cretonne, bleached cotton) are cut into 0.17 g pieces. Each piece is placed in a 2-m L well in a 48-well cell culture plate. Each fabric sample is exposed to 1 mL of each of the above solutions (Table 61) for a total of 36 samples (a control solution with no polymer is included for each fabric test). The fabric samples are allowed to sit for at least 30 minutes in the polymer solutions. The fabric samples are removed from the polymer solutions and rinsed in DI water for at least one minute to remove any unbound polymer. The fabric samples are then dried at 60° C. for at least 30 minutes until constant dryness is achieved. The fabric samples are weighed after drying and individually placed in 2-mL wells in a clean 48-well cell culture plate. The fabric samples are then exposed to 1 mL of a 250 ppm Toluidine Blue dye solution. The samples are left in the dye solution for at least 15 minutes. Each fabric sample is removed from the dye solution, after which the dye solution is diluted 10×.

The absorbance of the diluted solutions is measured compared to a control sample. A relative measure of CMG polymer adsorbed to the fabric is calculated based on the calibration curve created in Example 50 for Toluidine Blue dye. Specifically, the difference in UV absorbance for the fabric samples exposed to polymer compared to the controls (fabric not exposed to polymer) represents a relative measure of polymer adsorbed to the fabric. This difference in UV absorbance could also be expressed as the amount of dye bound to the fabric (over the amount of dye bound to control), which is calculated using the calibration curve (i.e., UV absorbance is converted to ppm dye). A positive value represents the dye amount that is in excess to the dye amount bound to the control fabric, whereas a negative value represents the dye amount that is less than the dye amount bound to the control fabric. A positive value would reflect that the CMG polymer adsorbed to the fabric surface.

It is believed that this assay would demonstrate that CMG polymer can adsorb to various types of fabric under different salt and pH conditions. This adsorption would suggest that the present glucan ether derivatives are useful in detergents for fabric care (e.g., as anti-redeposition agents).

Example 56

Effect of Cellulase on Carboxymethyl Glucan (CMG)

This example discloses how one could test the stability of an α-glucan ether, CMG, in the presence of cellulase compared to the stability of carboxymethyl cellulose (CMC). Stability to cellulase would indicate applicability of CMG to use in cellulase-containing compositions/processes such as in fabric care.

Solutions (1 wt %) of CMC ($M_w$=90000, DoS=0.7) or CMG are treated with cellulase or amylase as follows. CMG or CMC polymer (100 mg) is added to a clean 20-mL glass scintillation vial equipped with a PTFE stir bar. Water (10.0 mL) that has been previously adjusted to pH 7.0 using 5 vol % sodium hydroxide or 5 vol % sulfuric acid is then added to the scintillation vial, and the mixture is agitated until a solution (1 wt %) forms. A cellulase or amylase enzyme is added to the solution, which is then agitated for 24 hours at room temperature (~25° C.). Each enzyme-treated sample is analyzed by SEC (above) to determine the molecular weight of the treated polymer. Negative controls are conducted as above, but without the addition of a cellulase or amylase. Various enzymatic treatments of CMG and CMC that could be performed are listed in Table 62, for example.

TABLE 62

Measuring Stability of CMG and CMC Against Degradation by Cellulase or Amylase

| Polymer | Enzyme | Enzyme Type | Enzyme Loading |
|---|---|---|---|
| CMC | none | N/A | — |
| CMC | PURADAX HA 1200E | Cellulase | 1 mg/mL |
| CMC | PREFERENZ S 100 | Amylase | 3 μL/mL |
| CMG | none | N/A | — |
| CMG | PURADAX HA 1200E | Cellulase | 1 mg/mL |
| CMG | PREFERENZ S 100 | Amylase | 3 μL/mL |
| CMG | PURASTAR ST L | Amylase | 3 μL/mL |
| CMG | PURADAX EG L | Cellulase | 3 μL/mL |

It is believed that the enzymatic studies in Table 62 would indicate that CMC is highly susceptible to degradation by cellulase, whereas CMG is more resistant to this degradation. It is also believed that these studies would indicate that both CMC and CMG are largely stable to amylase.

Use of CMC for providing viscosity to an aqueous composition (e.g., laundry or dishwashing detergent) containing cellulase would be unacceptable. CMG on the other hand, given its stability to cellulase, would be useful for cellulase-containing aqueous compositions such as detergents.

Example 57

Effect of Cellulase on Carboxymethyl Glucan (CMG)

This example discloses how one could test the stability of the present α-glucan oligomer/polymer composition (unmodified) in the presence of cellulase compared to the stability of carboxymethyl cellulose (CMC). Stability to cellulase would indicate applicability of the present α-glucan oligomer/polymer composition to use in cellulase-containing compositions/processes, such as in fabric care.

Solutions (1 wt %) of CMC ($M_w$=90000, DoS=0.7) or the present α-glucan oligomer/polymer composition as described in Examples 30, 32, 33, 34, 36 or 37 are treated with cellulase or amylase as follows. The present α-glucan oligomer/polymer composition or CMC polymer (100 mg) is added to a clean 20-mL glass scintillation vial equipped with a PTFE stir bar. Water (10.0 mL) that has been previously adjusted to pH 7.0 using 5 vol % sodium hydroxide or 5 vol % sulfuric acid is then added to the scintillation vial, and the mixture is agitated until a solution (1 wt %) forms. A cellulase or amylase enzyme is added to the solution, which is then agitated for 24 hours at room temperature (~25° C.). Each enzyme-treated sample is analyzed by SEC (above) to determine the molecular weight of the treated polymer. Negative controls are conducted as above, but without the addition of a cellulase or amylase. Various enzymatic treatments of the present α-glucan oligomer/polymer composition and CMC that could be performed are listed in Table 63, for example.

TABLE 63

Measuring Stability of an a-Glucan Fiber Composition and CMC Against Degradation by Cellulase or Amylase

| Polymer | Enzyme | Enzyme Type | Enzyme Loading |
|---|---|---|---|
| CMC | none | N/A | — |
| CMC | PURADAX HA 1200E | Cellulase | 1 mg/mL |
| CMC | PREFERENZ S 100 | Amylase | 3 μL/mL |
| α-GF[1] | none | N/A | — |
| α-GF | PURADAX HA 1200E | Cellulase | 1 mg/mL |
| α-GF | PREFERENZ S 100 | Amylase | 3 μL/mL |
| α-GF | PURASTAR ST L | Amylase | 3 μL/mL |
| α-GF | PURADAX EG L | Cellulase | 3 μL/mL |

[1]= α-GF is the present α-glucan fiber.

It is believed that the enzymatic studies in Table 63 would indicate that CMC is highly susceptible to degradation by cellulase, whereas the present α-glucan oligomer/polymer composition is more resistant to this degradation. It is also believed that these studies would indicate that both CMC and the present α-glucan oligomer/polymer composition are largely stable to amylase.

Use of CMC for providing viscosity to an aqueous composition (e.g., laundry or dishwashing detergent) containing cellulase would be unacceptable. The present α-glucan oligomer/polymer composition (unmodified) on the other hand, given its stability to cellulase, would be useful for cellulase-containing aqueous compositions such as detergents.

Example 58

Preparation of Hydroxypropyl α-Glucan

This Example describes producing the glucan ether derivative, hydroxypropyl α-glucan.

Approximately 10 g of the present α-glucan oligomer/polymer composition as prepared in Examples 30, 32, 33, 34, 36 or 37 is mixed with 101 g of toluene and 5 mL of 20% sodium hydroxide. This preparation is stirred in a 500-mL glass beaker on a magnetic stir plate at 55° C. for 30 minutes. The preparation is then transferred to a shaker tube reactor after which 34 g of propylene oxide is added; the reaction is then stirred at 75° C. for 3 hours. The reaction is then neutralized with 20 g of acetic acid and the hydroxypropyl α-glucan formed is collected, washed with 70% aqueous ethanol or hot water, and dried. The molar substitution (MS) of the product is determined by NMR.

Example 59

Preparation of Hydroxyethyl α-Glucan

This Example describes producing the glucan ether derivative, hydroxyethyl poly alpha-1,3-glucan.

Approximately 10 g of the present α-glucan oligomer/polymer composition as prepared in Examples 30, 32, 33, 34, 36, or 37 is mixed with 150 mL of isopropanol and 40 mL of 30% sodium hydroxide. This preparation is stirred in a 500-mL glass beaker on a magnetic stir plate at 55° C. for 1 hour, and then is stirred overnight at ambient temperature. The preparation is then transferred to a shaker tube reactor after which 15 g of ethylene oxide is added; the reaction is then stirred at 60° C. for 6 hour. The reaction is then allowed to remain in the sealed shaker tube overnight (approximately 16 hours) before it is neutralized with 20.2 g of acetic acid thereby forming hydroxyethyl glucan. The hydroxyethyl glucan solids is collected and is washed in a beaker by adding a methanol:acetone (60:40 v/v) mixture and stirring with a stir bar for 20 minutes. The methanol:acetone mixture is then filtered away from the solids. This washing step is repeated two times prior to drying of the product. The molar substitution (MS) of the product is determined by NMR.

Example 60

Preparation of Ethyl α-Glucan

This Example describes producing the glucan ether derivative, ethyl glucan.

Approximately 10 g of the present α-glucan oligomer/polymer composition as prepared in Examples 30, 32, 33, 34, 36, or 37 is added to a shaker tube, after which sodium hydroxide (1-70% solution) and ethyl chloride are added to provide a reaction. The reaction is heated to 25-200° C. and held at that temperature for 1-48 hours before the reaction is neutralized with acetic acid. The resulting product is collected washed, and analyzed by NMR and SEC to determine the molecular weight and degree of substitution (DoS) of the ethyl glucan.

Example 61

Preparation of Ethyl Hydroxyethyl α-Glucan

This Example describes producing the glucan ether derivative, ethyl hydroxyethyl glucan.

Approximately 10 g of the present α-glucan oligomer/polymer composition as prepared in Examples 30, 32, 33, 34, 36, or 37 is added to a shaker tube, after which sodium hydroxide (1-70% solution) is added. Then, ethyl chloride is added followed by an ethylene oxide/ethyl chloride mixture to provide a reaction. The reaction is slowly heated to 25-200° C. and held at that temperature for 1-48 hours before being neutralized with acetic acid. The product formed is collected, washed, dried under a vacuum at 20-70° C., and then analyzed by NMR and SEC to determine the molecular weight and DoS of the ethyl hydroxyethyl glucan.

Example 62

Preparation of Methyl α-Glucan

This Example describes producing the glucan ether derivative, methyl glucan.

Approximately 10 g of the present α-glucan oligomer/polymer composition as prepared in Examples 30, 32, 33, 34, 36, or 37 is mixed with 40 mL of 30% sodium hydroxide and 40 mL of 2-propanol, and is stirred at 55° C. for 1 hour to provide alkali glucan. This preparation is then filtered, if needed, using a Buchner funnel. The alkali glucan is then mixed with 150 mL of 2-propanol. A shaker tube reactor is charged with the mixture and 15 g of methyl chloride is added to provide a reaction. The reaction is stirred at 70° C. for 17 hours. The resulting methyl glucan solid is filtered and neutralized with 20 mL 90% acetic acid, followed by three 200-mL ethanol washes. The resulting product is analyzed by NMR and SEC to determine the molecular weight and degree of substitution (DoS).

Example 63

Preparation of Hydroxyalkyl Methyl α-Glucan

This Example describes producing the glucan ether derivative, hydroxyalkyl methyl α-glucan.

Approximately 10 g of the present α-glucan oligomer/polymer composition as prepared in Examples 30, 32, 33, 34, 36, or 37 is added to a vessel, after which sodium hydroxide (5-70% solution) is added. This preparation is stirred for 0.5-8 hours. Then, methyl chloride is added to the vessel to provide a reaction, which is then heated to 30-100° C. for up to 14 days. An alkylene oxide (e.g., ethylene oxide, propylene oxide, butylene oxide, etc.) is then added to the reaction while controlling the temperature. The reaction is heated to 25-100° C. for up to 14 days before being neutralized with acid. The product thus formed is filtered, washed and dried. The resulting product is analyzed by NMR and SEC to determine the molecular weight and degree of substitution (DoS).

Example 64

Preparation of Carboxymethyl Hydroxyethyl α-Glucan

This Example describes producing the glucan ether derivative, carboxymethyl hydroxyethyl glucan.

Approximately 10 g of the present α-glucan oligomer/polymer composition as prepared in Examples 30, 32, 33, 34, 36, or 37 is added to an aliquot of a substance such as isopropanol or toluene in a 400-mL capacity shaker tube, after which sodium hydroxide (1-70% solution) is added. This preparation is stirred for up to 48 hours. Then, monochloroacetic acid is added to provide a reaction, which is then heated to 25-100° C. for up to 14 days. Ethylene oxide is then added to the reaction, which is then heated to 25-100° C. for up to 14 days before being neutralized with acid (e.g., acetic, sulfuric, nitric, hydrochloric, etc.). The product thus formed is collected, washed and dried. The resulting product is analyzed by NMR and SEC to determine the molecular weight and degree of substitution (DoS).

Example 65

Preparation of Sodium Carboxymethyl Hydroxyethyl α-Glucan

This Example describes producing the glucan ether derivative, sodium carboxymethyl hydroxyethyl glucan.

Approximately 10 g of the present α-glucan oligomer/polymer composition as prepared in Example 30, 32, 33, 34, 36, or 37 is added to an aliquot of an alcohol such as isopropanol in a 400-mL capacity shaker tube, after which sodium hydroxide (1-70% solution) is added. This preparation is stirred for up to 48 hours. Then, sodium monochloroacetate is added to provide a reaction, which is then heated to 25-100° C. for up to 14 days. Ethylene oxide is then added to the reaction, which is then heated to 25-100° C. for up to 14 days before being neutralized with acid (e.g., acetic, sulfuric, nitric, hydrochloric, etc.). The product thus formed is collected, washed and dried. The resulting product is analyzed by NMR and SEC to determine the molecular weight and degree of substitution (DoS).

Example 66

Preparation of Carboxymethyl Hydroxypropyl α-Glucan

This Example describes producing the glucan ether derivative, carboxymethyl hydroxypropyl glucan.

Approximately 10 g of the present α-glucan oligomer/polymer composition as prepared in Examples 30, 32, 33, 34, 36, or 37 is added to an aliquot of a substance such as isopropanol or toluene in a 400-mL capacity shaker tube, after which sodium hydroxide (1-70% solution) is added. This preparation is stirred for up to 48 hours. Then, monochloroacetic acid is added to provide a reaction, which is then heated to 25-100° C. for up to 14 days. Propylene oxide is then added to the reaction, which is then heated to 25-100° C. for up to 14 days before being neutralized with acid (e.g., acetic, sulfuric, nitric, hydrochloric, etc.). The solid product thus formed is collected, washed and dried. The resulting product is analyzed by NMR and SEC to determine the molecular weight and degree of substitution (DoS).

Example 67

Preparation of Sodium Carboxymethyl Hydroxypropyl α-Glucan

This Example describes producing the glucan ether derivative, sodium carboxymethyl hydroxypropyl glucan.

Approximately 10 g of the present α-glucan oligomer/polymer composition as prepared in Examples 30, 32, 33, 34, 36, or 37 is added to an aliquot of a substance such as isopropanol or toluene in a 400-mL capacity shaker tube, after which sodium hydroxide (1-70% solution) is added. This preparation is stirred for up to 48 hours. Then, sodium monochloroacetate is added to provide a reaction, which is then heated to 25-100° C. for up to 14 days. Propylene oxide is then added to the reaction, which is then heated to 25-100° C. for up to 14 days before being neutralized with acid (e.g., acetic, sulfuric, nitric, hydrochloric, etc.). The product thus formed is collected, washed and dried. The resulting product is analyzed by NMR and SEC to determine the molecular weight and degree of substitution (DoS).

Example 68

Preparation of Potassium Carboxymethyl α-Glucan

This Example describes producing the glucan ether derivative, potassium carboxymethyl glucan.

Approximately 10 g of the present α-glucan oligomer/polymer composition as prepared in Examples 30, 32, 33, 34, 36, or 37 is added to 200 mL of isopropanol in a 500-mL capacity round bottom flask fitted with a thermocouple for temperature monitoring and a condenser connected to a recirculating bath, and a magnetic stir bar. 40 mL of potassium hydroxide (15% solution) is added drop wise to this preparation, which is then heated to 25° C. on a hotplate. The preparation is stirred for 1 hour before the temperature is increased to 55° C. Potassium chloroacetate (12 g) is then added to provide a reaction, which was held at 55° C. for 3 hours before being neutralized with 90% acetic acid. The product formed was collected, washed with ethanol (70%), and dried under vacuum at 20-25° C. The resulting product is analyzed by NMR and SEC to determine the molecular weight and degree of substitution (DoS).

Example 69

Preparation of Lithium Carboxymethyl α-Glucan

This Example describes producing the glucan ether derivative, lithium carboxymethyl glucan.

Approximately 10 g of the present α-glucan oligomer/polymer composition as prepared in Examples 30, 32, 33, 34, 36, or 37 is added to 200 mL of isopropanol in a 500-mL capacity round bottom flask fitted with a thermocouple for temperature monitoring and a condenser connected to a recirculating bath, and a magnetic stir bar. 50 mL of lithium hydroxide (11.3% solution) is added drop wise to this preparation, which is then heated to 25° C. on a hotplate. The preparation is stirred for 1 hour before the temperature is increased to 55° C. Lithium chloroacetate (12 g) is then added to provide a reaction, which is held at 55° C. for 3 hours before being neutralized with 90% acetic acid. The product formed is collected, washed with ethanol (70%), and dried under vacuum at 20-25° C. The resulting product is analyzed by NMR and SEC to determine the molecular weight and degree of substitution (DoS).

Example 70

Preparation of a Dihydroxyalkyl α-Glucan

This Example describes producing a dihydroxyalkyl ether derivative of α-glucan. Specifically, dihydroxypropyl glucan is produced.

Approximately 10 g of the present α-glucan oligomer/polymer composition as prepared in Examples 30, 32, 33, 34, 36, or 37 is added to 100 mL of 20% tetraethylammonium hydroxide in a 500-mL capacity round bottom flask fitted with a thermocouple for temperature monitoring and a condenser connected to a recirculating bath, and a magnetic stir bar (resulting in -9.1 wt % poly alpha-1,3-glucan). This preparation is stirred and heated to 30° C. on a hotplate. The preparation is stirred for 1 hour to dissolve any solids before the temperature is increased to 55° C. 3-chloro-1,2-propanediol (6.7 g) and 11 g of DI water were then added to provide a reaction (containing ~5.2 wt % 3-chloro-1,2-propanediol), which is held at 55° C. for 1.5 hours after which time 5.6 g of DI water is added to the reaction. The reaction is held at 55° C. for an additional 3 hours and 45 minutes before being neutralized with acetic acid. After neutralization, an excess of isopropanol is added. The product formed was collected, washed with ethanol (95%), and dried under vacuum at 20-25° C. The resulting product is analyzed by NMR and SEC to determine the molecular weight and degree of substitution (DoS).

SEQUENCE LISTING (153 sequences)

SEQ ID NO: 1 - DNA, 36 bp, artificial sequence
  synthetic construct
ataaaaaacgctcggttgccgccgggcgttttttat

SEQ ID NO: 2 - DNA, 21 bp, artificial sequence
  synthetic construct
ggatcctgactgcctgagctt

SEQ ID NO: 3 - protein, 1518 aa, Streptococcus salivarius
MENKIHYKLHKVKKQWVTIAVASVALATVLGGLSVTTSSVSADETQDKTVTQSNSGTTASLVTSPEATKEADKRTNTKEADVLTPAKETNAVETATTTNTQATAEAATTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 4 - DNA, 4434 bp, Streptococcus salivarius
atggacgaaacgcaggataagaccgtgacgcagagcaacagcggcaccaccgcttccctggtcactagccctgaagccacgaaagaggcggacaaacgcacgaacactaaagaggccgacgttctgacgcctgcaaaagaaacgaacgcagtcgagactgcgaccaccactaacacccaggcgacggcggaggccgccacgaccgcgaccaccgcggacgtcgcggtggctgcggtgccgaacaaagaagcggtcgttaccacggatgctccggcggtcacgaccgagaaagcggaagaacagccggctaccgttaaagcagaagtcgtcaatacggaagtgaaagcgccggaagcggctctgaaagacagcgaggttgaggcagcgctgagcctgaagaacatcaagaacattgatggcaagtattactatgttaatgaggatggcagccacaaagagaatttcgctattaccgtgaatggccagctgctgtactttggtaaagacggtgcgctgacgtcctctagcacgtattcttttaccccaggcactaccaatatcgtggacggttttagcattaacaaccgcgcttacgacagcagcgaggcgagctttgagctgatcgacggttacttgaccgcagacagctggtatcgtccggctagcatcatcaaagatggtgttacgtggcaagcgtccaccgccgaggattttcgtccgctgctgatggcatggtggccgaatgtggatacgcaggtgaactatttgaattacatgtccaaagttttcaacctggacgcgaaatactctagcaccgacaaacaggaaaccctgaaagtggcagcaaaagacattcaaatcaagattgaacaaaagattcaagcggagaagagcacgcagtggctgcgtgaaactatcagcgcctttgtgaaaacccagccgcagtggaacaaagaaaccgagaattacagcaagggtggtggtgaggaccacctgcaaggtggcgcactgctgtatgttaacgacagccgtaccccttgggcgaatagcgattaccgtcgtctgaatcgcaccgcaaccaatcagacgggcacgatcgataagtctattctggacgagcagtctgacccaaaccacatgggcggtttcgactttctgctggcgaacgacgtcgacctgagcaatccggtcgtgcaggctgagcagctgaatcaaatccactatctgatgaattggggttccattgtgatgggtgacaaggatgcgaactttgacggcattcgtgtcgatgcagttgacaacgtggacgcggacatgttgcaactgtataccaattacttccgtgagtactacggtgtgaacaagagcgaagctaacgcactggctcacatcagcgttctggaggcgtggagcctgaatgataatcattacaatgacaagaccgatggtgcggcactggcaatggagaataagcaacgtctggcgctgttgttttcgttggcgaaaccgatcaaagagcgtaccccggcagtgagcccgctgtataacaacaccttcaataccacccagcgtgatgaaaagaccgattggattaacaaagacggtagcaaggcttacaacgaagatggcacggtcaaacaatcgaccatcggtaagtacaacgagaaatacggtgacgcatccggtaactacgttttcatccgtgcccacgataacaacgtccaggacatcatcgccgagatcatcaagaaagagatcaacccgaaaagcgacggcttcaccatcaccgacgccgaaatgaagcaagcctttgaaatctataacaaagatatgctgtcgagcgacaaaaagtataccctgaataacattccggcagcgtatgccgtgatgttgcagaatatggaaacgattacccgcgtctattacggtgatctgtatacggacgacggtcactacatggaaaccaaatctccgtattacgataccatcgtgaatttgatgaagagccgtatcaagtatgtttcgggtggccaggcgcaacgtagctattggctgccgaccgacggtaagatggacaatagcgacgttgagctgtaccgcacgaatgaggtttacacgagcgtgcgctatggtaaggatatcatgaccgctaatgataccgaaggctctaagtattcccgcaccagcggccaagtcaccttggtcgcgaacaatccgaagctgaatctggaccaaagcgccaagttgaatgtggagatgggcaaaatccatgcgaatcagaagtatcgcgcactgattgtcggcactgcggacggcattaagaactttacttccgacgcggacgccattgcagcgggttatgtgaaagaaaccgatagcaacggcgtgctgaccttcggtgctaacgacattaagggctacgaaacgtttgatatgagcggtttcgtggcggtgtgggttccggtgggtgcatctgacaatcaggacattcgtgttgcgccgagcaccgaggcaaagaaagaaggtgagctgaccttgaaggcgacggaagcgtatgatagccagctgatttacgaaggctttagcaatttccagacgatcccagatggcagcgatccgtccgtgtatacgaaccgcaagattgcggagaacgtggatctgttcaaaagctggggtgtcaccagctttgagatggcaccgcaatttgtctcggcggatgatggcacctttctggatagcgttattcagaatggctacgccttcgccgaccgttatgacctggccatgtccaagaacaacaagtatggtagcaaagaggacctgcgtgatgcactgaaagcactgcataaggcgggtattcaagctatcgcagactgggttccagaccagatctaccagctgccgggcaaagaagttgtcaccgccacccgtacggatggtgctggccgtaagatcgcagacgcgattatcgaccattctctgtatgttgcaaacagcaaaagcagcggcaaagattatcaagcaaagtacggtggcgagttcctggccgagctgaaagccaaatacccggaaatgttcaaagttaacatgattagcacgggtaagccgattgatgactccgtgaaattgaagcaatggaaagccgagtacttcaatggcaccaacgttttggaacgtggtgtcggctatgttctgagcgacgaggcgaccggtaagtatttcacggtgaccaaagaaggcaatttcattccgctgcaactgacgggtaaagagaaagttatcacgggtttctccagcgatggtaagggtatcacctatttcggtacgagcggtacgcaggcgaagtctgcgtttgttaccttcaatggtaacacctactatttcgacgcgcgtggccacatggttaccaatagcgaatacagcccgaatggcaaggacgtctaccgttttctgccgaacggtatcatgctgagcaatgcgttttacattgatgcgaacggtaatacctacctgtacaactctaagggtcaaatgtacaaaggcggttacacgaaattcgatgtttctgaaacggataaggacggtaaagagtccaaggtcgtcaagttccgctactttacgaacgaaggcgtcatggccaagggtgttaccgtcattgatggttttacccaatacttcggtgaggacggctttcaagcgaaggataagctggtcaccttcaagggcaagacgtattacttcgacgcacacactggtaatggtatcaaagatacctggcgcaatatcaatggtaaatggtactatttcgacgcgaatggcgttgctgcgaccggtgcgcaggtgattaacggccagaaactgtacttcaacgaggatggctcccaagtcaaaggcggcgtggttaagaacgcagacggcacctatagcaaatacaaagaaggttttggtgagctggttactaacgagtttttcacgactgatggcaatgtttggtactacgccggtgcaaatggtaaaaccgttaccggtgcacaagtgatcaacggccaacatttgtacttcaatgcggacggttcccaggtgaagggtggcgttgtcaagaacgcggatggcacctacagcaagtacaatgctagcactggtgaacgtctgacgaacgagttctttacgaccggtgataacaattggtattacattggcgcaaacggtaagagcgtgacgggtgaggtcaagattggtgatgatacttactttttcgcgaaggatggcaaacaagttaaaggtcaaaccgtcagcgccggtaatggtcgcattagctactactacggtgacagcggcaagcgtgcggttagcacctggattgagattcagccgggtgtttatgtgtatttcgacaaaaacggtttggcgtaccctccgcgtgttctgaattaa

SEQ ID NO: 5 - protein, 1477 aa, Streptococcus salivarius
MDETQDKTVTQSNSGTTASLVTSPEATKEADKRTNTKEADVLTPAKETNAVETATTTNTQATAEAATTATTADVAVAAVPNKEAVVTTDAPAVTTEKAEEQPATVKAEVVNTEVKAPEAALKDSEVEAALSLKNIKNIDGKYYYVNEDGSHKENFAITVNGQLLYFGKDGALTSSSTYSFTPGTTNIVDGFSINNRAYDSSEASFELIDGYLTADSWYRPASIIKDGVTWQASTAEDFRPLLMAWWPNVDTQVNYLNYMSKVFNLDAKYSSTDKQETLKVAAKDIQIKIEQKIQAEKSTQWLRETISAFVKTQPQWNKETENYSKGGGEDHLQGGALLYVNDSRTPWANSDYRRLNRTATNQTGTIDKSILDEQSDPNHMGGFDFLLANDVDLSNPVVQAEQLNQIHYLMNWGSIVMGDKDANFDGIRVDAVDNVDADMLQLYTNYFREYYGVNKSEANALAHISVLEAWSLNDNHYNDKTDGAALAMENKQRLALLFSLAKPIKERTPAVSPLYNNTFNTTQRDEKTDWINKDGSKAYNEDGTVKQSTIGKYNEKYGDASGNYVFIRAHDNNVQDIIAEIIKKEINPKSDGFTITDAEMKQAFEIYNKDMLSSDKKYTLNNIPAAYAVMLQNMETITRVYYGDLYTDDGHYMETKSPYYDTIVNLMKSRIKYVSGGQAQRSYWLPTDGKMDNSDVELYRTNEVYTSVRYGKDIMTANDTEGSKYSRTSGQVTLVANNPKLNLDQSAKLNVEMGKIHANQKYRALIVGTADGIKNFTSDADAIAAGYVKETDSNGVLTFGANDIKGYETFDMSGFVAVWVPVGASDNQDIRVAPSTEAKKEGELTLKATEAYDSQLIYEGFSNFQTIPDGSDPSVYTNRKIAENVDLFKSWGVTSFEMAPQFVSADDGTFLDSVIQNGYAFADRYDLAMSKNNKYGSKEDLRDALKALHKAGIQAIADWVPDQIYQLPGKEVVTATRTDGAGRKIADAIIDHSLYVANSKSSGKDYQAKYGGEFLAELKAKYPEMFKVNMISTGKPIDDSVKLKQWKAEYFNGTNVLERGVGYVLSDEATGKYFTVTKEGNFIPLQLTGKEKVITGFSSDGKGITYFGTSGTQAKSAFVTFNGNTYYFDARGHMVTNSEYSPNGKDVYRFLPNGIMLSNAFYIDANGNTYLYNSKGQMYKGGYTKFDVSETDKDGKESKVVKFRYFTNEGVMAKGVTVIDGFTQYFGEDGFQAKDKLVTFKGKTYYFDAHTGNGIKDTWRNINGKWYYFDANGVAATGAQVINGQKLYFNEDGSQVKGGVVKNADGTYSKYKEGFGELVTNEFFTTDGNVWYYAGANGKTVTGAQVINGQHLYFNADGSQVKGGVVKNADGTYSKYNASTGERLTNEFFTTGDNNWYYIGANGKSVTGEVKIGDDTYFFAKDGKQVKGQTVSAGNGRISYYYGDSGKRAVSTWIEIQPGVYVYFDKNGLAYPPRVLN

SEQ ID NO: 6 - protein, 1449 aa, Streptococcus salivarius
MDKKVHYKMHKVKKQWVTIAVTGLSLGAVSAVSLGTNDGVVQADEHTDATVAIPDITVDTGTVSNDTTAAQDPTTAVAATNDVATDQATPTATFDLTTDTTNTVAANAVDTVATVGTDRAATTNDTTATNDTAVDTTNNNTTTDTTTVTDRAATTERRATGARRGPTGGRRATPVNGNTNNANNTVTVVNNDLPATNNVVTDGPSHIKTINGKQYYVEDDGTIRKNYVLERIGGSQYFNAETGELSNQKEYRFDKNGGTGSSADSTNTNVTVNGDKNAFYGTTDKDIELVDGYFTANTWYRPKEILKDGKEWTASTENDKRPLLTVWWPSKAIQASYLNYMKEQGLGTNQTYTSFSSQTQMDQAALEVQKRIEERIAREGNTDWLRTTIKNFVKTQPGWNSTSENLDNNDHLQGGALLYNNDSRTSHANSDYRLLNRTPTSQTGKHNPKYTKDTSNGGFEFLLANDIDNSNPAVQAEQLNWLHYIMNIGTITGGSEDENFDGVRVDAVDNVNADLLQIASDYFKAKYGADQSQDQAIKHLSILEAWSHNDAYYNEDTKGAQLPMDDPMHLALVYSLLRPIGNRSGVEPLISNSLNDRSESGKNSKRMANYAFVRAHDSEVQSIIGQIIKNEINPQSTGNTFTLDEMKKAFEIYNKDMRSANKQYTQYNIPSAYALMLTHKDTVPRVYYGDMYTDDGQYMAQKSPYYDAIETLLKGRIRYAAGGQDMKVNYIGYGNTNGWDAAGVLTSVRYGTGANSASDTGTAETRNQGMAVIVSNQPALRLTSNLTINMGAAHRNQAYRPLLLTTNDGVATYLNDSDANGIVKYTDGNGNLTFSANEIRGIRNPQVDGYLAVWVPVGASENQDVRVAPSKEKNSSGLVYESNAALDSQVIYEGFSNFQDFVQNPSQYTNKKIAENANLFKSWGITSFEFAPQYVSSDDGSFLDSVIQNGYAFTDRYDIGMSKDNKYGSLADLKAALKSLHAVGISAIADWVPDQIYNLPGDEVVTATRVNNYGETKDGAIIDHSLYAAKTRTFGNDYQGKYGGAFLDELKRLYPQIFDRVQISTGKRMTTDEKITQWSAKYMNGTNILDRGSEYVLKNGLNGYYGTNGGKVSLPKVVGSNQSTNGDNQNGDGSGKFEKRLFSVRYRYNNGQYAKNAFIKDNDGNVYYFDNSGRMAVGEKTIDGKQYFFLANGVQLRDGYRQNRRGQVFYYDQNGVLNANGKQDPKPDNNNNASGRNQFVQIGNNVWAYYDGNGKRVTGHQNINGQELFFDNNGVQVKGRTVNENGAIRYYDANSGEMARNRFAEIEPGVWAYFNNDGTAVKGSQNINGQDLYFDQNGRQVKGALANVDGNLRYYDVNSGELYRNRFHEIDGSWYYFDGNGNAVKGMVNINGQNLLFDNNGKQIKGHLVRVNGVVRYFDPNSGEMAVNRWVEVSPGWWVYFDGEGRGQI

SEQ ID NO: 7 - DNA, 3744 bp, Streptococcus salivarius
atgccaagccacattaagaccatcaacggcaaacaatactacgtggaggatgacggtacgattcgcaagaattacgtcctggagcgtatcggtggcagccaatactttaatgcagaaaccggtgaactgtctaatcagaaagagtatcgtttcgacaaaaatggtggtactggtagcagcgcggacagcacgaacaccaacgtgactgtgaacggtgacaaaaacgcattttacggtaccacggacaaagacattgagctggtcgacggctatttcaccgcgaacacctggtatcgcccgaaagaaatcctgaaagacggcaaagaatggaccgccagcacggagaacgataaacgcccgctgctgaccgtctggtggcctagcaaagcaatccaggcgtcttatctgaactacatgaaagagcaaggcctgggtaccaaccaaacgtacacgagcttctccagccaaacccaaatggatcaagcagccctggaagtgcaaaagcgtattgaagagcgcatcgcacgcgagggcaataccgactggctgcgcacgaccatcaagaacttcgtgaaaacccaaccgggttggaacagcacctctgaaaatctggacaataatgatcatctgcaaggtggcgccctgctgtacaataacgactcccgcacgagccacgcgaacagcgactatcgcctgctgaatcgtacgccgaccagccagaccggcaaacacaatccgaaatacaccaaagataccagcaatggtggtttcgaatttctgctggcgaacgacatcgataactctaatccggcggttcaagcagagcaactgaactggctgcattacattatgaacatcggtaccatcacgggcggttctgaggatgaaaacttcgacggcgttcgtgttgacgctgtggataatgtgaatgcggatctgctgcaaatcgcgagcgactatttcaaagcaaaatacggtgctgatcaaagccaagatcaggcgatcaaacacttgagcatcctggaagcgtggtcccataacgacgcctactataacgaagataccaaaggcgcgcagttgccgatggatgatccgatgcacctggctctggtctactcgctgctgcgtccgatcggcaatcgcagcggtgtggaaccgctgatttccaacagcctgaatgaccgtagcgagtccggtaagaacagcaaacgtatggcgaactacgcgttcgtacgcgcgcatgatagcgaggtgcaatcgattattggccagatcatcaaaaacgagatcaatccgcaaagcaccggtaatacgttcaccctggatgagatgaagaaagcgtttgagatttacaacaaggatatgcgtagcgcgaataagcagtatacgcagtacaacatcccgagcgcgtatgcgttgatgctgacccacaaggataccgttccgcgtgtgtattacggtgatatgtatacggacgacggtcagtacatggcgcaaaagagcccatactatgatgcgatcgaaacgctgctgaaaggtcgcatccgctatgccgcaggtggtcaggacatgaaggtcaactatattggttacggtaacactaacggctgggatgctgcgggcgtgctgaccagcgtacgttatggcacgggcgcaaatagcgccagcgatacgggtaccgccgaaacgcgtaatcaaggtatggcagtgattgttagcaaccaaccggcgctgcgtctgactagcaatttgaccattaacatgggtgccgcacaccgtaatcaggcttaccgtccgctgctgctgacgaccaacgatggcgtcgcgacctatttgaacgatagcgatgcgaatggtatcgttaagtacaccgacggtaatggtaatctgaccttctccgcaaacgagattcgtggcatccgtaacccgcaagttgatggctatctggccgtctgggttccggtaggtgcgtcggagaatcaggatgttcgtgtggcgccgagcaaagagaagaacagctccggtctggtttacgagagcaatgctgccctggatagccaagttatctacgaaggcttcagcaacttccaggacttcgttcagaatccgagccagtataccaacaaaaagattgcagagaatgcaaatttgttcaaatcctggggtattaccagctttgaatttgcgccgcagtacgtgagctcggatgatggtagcttcctggacagcgttattcagaacggttatgcgtttacggaccgctacgacattggtatgagcaaagacaacaaatatggttcgctggcggatttgaaggcagcactgaagagcttgcatgccgttggtattagcgcaatcgcggattgggttcctgatcagatctacaatctgccaggcgacgaggtcgtcaccgcaacccgcgttaacaactacggcgaaaccaaagatggtgcaatcattgatcactctttgtacgcggccaaaacccgtacttttggtaacgactaccagggtaagtatggtggtgcgttcctggacgagctgaaacgtctgtatccgcagatctttgaccgcgttcagatttctaccggtaagcgcatgaccacggacgagaagatcacccaatggtctgcaaagtatatgaacggtacgaacatcttggaccgtggctctgaatacgttttgaagaatggtctgaatggttactatggcaccaatggtggcaaagtttcgctgccgaaagttgtgggtagcaatcaaagcacgaatggcgacaatcaaaacggcgacggtagcggcaagtttgaaaagcgtctgttcagcgtgcgttaccgttataacaatggccagtacgcgaaaaatgcctttatcaaagataacgacggcaatgtttactatttcgacaatagcggtcgtatggctgtcggtgagaaaacgattgacggcaagcagtacttcttcctggctaatggcgttcagctgcgtgacggctaccgtcaaaatcgtcgcggtcaggtgttttactacgaccagaatggtgtgctgaacgcaaacggtaaacaagacccgaagcctgacaacaataacaatgcgagcggccgtaatcaattcgtccagatcggtaacaacgtgtgggcgtattatgatggcaatggtaaacgtgtcaccggtcaccagaacatcaacggtcaggagttgtttttcgataacaacggtgtccaggttaagggtcgtacggtgaatgagaacggtgcaattcgctactatgacgcgaatagcggtgagatggcacgcaatcgtttcgcggagattgaaccgggcgtctgggcatactttaacaatgacggcaccgcagtgaagggttctcagaatatcaatggtcaagacctgtacttcgaccagaacggtcgtcaggtcaagggtgcgctggccaatgttgatggcaacctgcgctattacgacgttaacagcggtgagctgtaccgtaatcgtttccacgaaatcgacggcagctggtattactttgatggtaacggtaatgcggtgaagggtatggtcaatatcaacggccaaaatctgttgtttgacaataacggcaaacagattaagggtcatctggtccgcgtcaacggcgtcgtgcgctattttgatccgaactctggtgaaatggcggttaatcgttgggttgaggtgagcccaggttggtgggtttactttgacggtgaaggtcgtggtcagatctaa

SEQ ID NO: 8 - protein, 1247 aa, Streptococcus salivarius
MPSHIKTINGKQYYVEDDGTIRKNYVLERIGGSQYFNAETGELSNQKEYRFDKNGGTGSSADSTNTNVTVNGDKNAFYGTTDKDIELVDGYFTANTWYRPKEILKDGKEWTASTENDKRPLLTVWWPSKAIQASYLNYMKEQGLGTNQTYTSFSSQTQMDQAALEVQKRIEERIAREGNTDWLRTTIKNFVKTQPGWNSTSENLDNNDHLQGGALLYNNDSRTSHANSDYRLLNRTPTSQTGKHNPKYTKDTSNGGFEFLLANDIDNSNPAVQAEQLNWLHYIMNIGTITGGSEDENFDGVRVDAVDNVNADLLQIASDYFKAKYGADQSQDQAIKHLSILEAWSHNDAYYNEDTKGAQLPMDDPMHLALVYSLLRPIGNRSGVEPLISNSLNDRSESGKNSKRMANYAFVRAHDSEVQSIIGQIIKNEINPQSTGNTFTLDEMKKAFEIYNKDMRSANKQYTQYNIPSAYALMLTHKDTVPRVYYGDMYTDDGQYMAQKSPYYDAIETLLKGRIRYAAGGQDMKVNYIGYGNTNGWDAAGVLTSVRYGTGANSASDTGTAETRNQGMAVIVSNQPALRLTSNLTINMGAAHRNQAYRPLLLTTNDGVATYLNDSDANGIVKYTDGNGNLTFSANEIRGIRNPQVDGYLAVWVPVGASENQDVRVAPSKEKNSSGLVYESNAALDSQVIYEGFSNFQDFVQNPSQYTNKKIAENANLFKSWGITSFEFAPQYVSSDDGSFLDSVIQNGYAFTDRYDIGMSKDNKYGSLADLKAALKSLHAVGISAIADWVPDQIYNLPGDEVVTATRVNNYGETKDGAIIDHSLYAAKTRTFGNDYQGKYGGAFLDELKRLYPQIFDRVQISTGKRMTTDEKITQWSAKYMNGTNILDRGSEYVLKNGLNGYYGTNGGKVSLPKVVGSNQSTNGDNQNGDGSGKFEKRLFSVRYRYNNGQYAKNAFIKDNDGNVYYFDNSGRMAVGEKTIDGKQYFFLANGVQLRDGYRQNRRGQVFYYDQNGVLNANGKQDPKPDNNNNASGRNQFVQIGNNVWAYYDGNGKRVTGHQNINGQELFFDNNGVQVKGRTVNENGAIRYYDANSGEMARNRFAEIEPGVWAYFNNDGTAVKGSQNINGQDLYFDQNGRQVKGALANVDGNLRYYDVNSGELYRNRFHEIDGSWYYFDGNGNAVKGMVNINGQNLLFDNNGKQIKGHLVRVNGVVRYFDPNSGEMAVNRWVEVSPGWWVYFDGEGRGQI

SEQ ID NO: 9 - protein, 1476 aa, Streptococcus mutans
MDKKVRYKLRKVKKRWVTVSVASAVMTLTTLSGGLVKADSNESKSQISNDSNTSVVTANEESNVTTEATSKQEAASSQTNHTVTTSSSSTSVVNPKEVVSNPYTVGETASNGEKLQNQTTTVDKTSEAAANNISKQTTEADTDVIDDSNAANIQILEKLPNVKEIDGKYYYYDNNGKVRTNFTLIADGKILHFDETGAYTDTSIDTVNKDIVTTRSNLYKKYNQVYDRSAQSFEHVDHYLTAESWYRPKYILKDGKTWTQSTEKDFRPLLMTWWPSQETQRQYVNFMNAQLGINKTYDDTSNQLQLNIAAATIQAKIEAKITTLKNTDWLRQTISAFVKTQSAWNSDSEKPFDDHLQNGAVLYDNEGKLTPYANSNYRILNRTPTNQTGKKDPRYTADNTIGGYEFLLANDVDNSNPVVQAEQLNWLHFLMNFGNIYANDPDANFDSIRVDAVDNVDADLLQIAGDYLKAAKGIHKNDKAANDHLSILEAWSDNDTPYLHDDGDNMINMDNKLRLSLLFSLAKPLNQRSGMNPLITNSLVNRTDDNAETAAVPSYSFIRAHDSEVQDLIRDIIKAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKAMDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYALPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFNISDNKEINFLPKTLLNQDSQVGFSYDGKGYVYYSTSGYQAKNTFISEGDKWYYFDNNGYMVTGAQSINGVNYYFLPNGLQLRDAILKNEDGTYAYYGNDGRRYENGYYQFMSGVWRHFNNGEMSVGLTVIDGQVQYFDEMGYQAKGKFVTTADGKIRYFDKQSGNMYRNRFIENEEGKWLYLGEDGAAVTGSQTINGQHLYFRANGVQVKGEFVTDRHGRISYYDGNSGDQIRNRFVRNAQGQWFYFDNNGYAVTGARTINGQHLYFRANGVQVKGEFVTDRHGRISYYDGNSGDQIRNRFVRNAQGQWFYFDNNGYAVTGARTINGQHLYFRANGVQVKGEFVTDRYGRISYYDGNSGDQIRNRFVRNAQGQWFYFDNNGYAVTGARTINGQHLYFRANGVQVKGEFVTDRYGRISYYDANSGERVRIN

SEQ ID NO: 10 - DNA, 3942 bp, Streptococcus mutans
atgattgacggcaaatactactactatgacaacaacggcaaagtacgcaccaatttcacgttgatcgcggacggtaaaatcctgcattttgatgaaactggcgcgtacaccgacactagcattgataccgtgaacaaggatattgtcacgacgcgtagcaacctgtataagaaatacaatcaagtgtatgatcgcagcgcgcagagcttcgagcatgttgatcactacctgacggcggaatcttggtaccgtccgaaatacattctgaaagatggcaagacctggacccagagcaccgagaaggacttccgtcctctgctgatgacctggtggccgagccaggaaacgcagcgccagtatgtcaacttcatgaacgcccagttgggtatcaacaaaacgtacgacgacaccagcaatcagctgcaattgaacatcgctgctgcaacgatccaagcaaagatcgaagccaaaatcacgacgctgaagaacaccgattggctgcgtcaaacgatcagcgcgttcgtcaaaacccaaagcgcttggaatagcgacagcgaaaagccgtttgatgaccatctgcaaaacggtgcggttctgtatgataacgaaggtaaattgacgccgtatgccaatagcaactatcgtattctgaaccgcacgccgaccaaccagaccggtaagaaggacccgcgttataccgccgacaacacgatcggcggctacgagtttctgctggccaacgacgtggataatagcaacccggtggttcaggccgagcagctgaactggctgcacttcctgatgaactttggtaatatctacgcaaacgaccctgacgctaacttcgactccatccgcgttgacgctgtcgataatgtggacgccgatctgttacagatcgcgggtgactatctgaaagcggcaaagggcatccataagaatgacaaagcggcgaacgaccacctgtccattctggaagcgtggagcgacaatgacactccgtatctgcatgatgatggcgacaacatgattaacatggataacaaactgcgcctgagcctgctgttctccctggcgaaaccgctgaatcagcgtagcggtatgaacccgttgattacgaacagcctggtcaaccgtactgatgataatgccgaaacggcggcagtgccaagctactcttttatccgtgcccacgatagcgaggtccaggatttgattcgtgatatcattaaggctgagattaacccgaacgtcgtcggttacagcttcacgatggaagagattaagaaggcatttgagatctacaataaggacctgttggccacggagaagaagtatacccactataacaccgcattgagctacgcgttgctgctgacgaacaagagcagcgtgccgcgtgtctactatggtgatatgtttacggacgatggtcaatacatggcccacaagaccattaactacgaggcaatcgaaaccctgctgaaagcacgtatcaagtacgtgtccggtggtcaggctatgcgcaaccagcaagtgggtaattcggagatcatcaccagcgtgcgttacggtaaaggtgcgctgaaggcgatggatacgggtgaccgcactacccgtacctctggtgtggcggtcattgagggcaacaacccgagcttgcgcctgaaggcttctgatcgtgtggttgtgaatatgggtgcggcccacaaaaatcaagcctatcgcccgctgctgttgacgaccgataacggcattaaggcctatcacagcgaccaagaagcggcaggcctggtgcgttacaccaacgaccgtggcgaactgatctttaccgcagccgacattaagggctacgcaaatccgcaagttagcggctacctgggcgtctgggtccctgttggcgcagcagctgatcaggacgttcgtgttgcggcgagcaccgcgccaagcacggacggcaagagcgttcaccagaacgcggctctggacagccgtgtgatgttcgagggtttctcgaacttccaggcatttgctaccaagaaagaagagtataccaatgtggtcatcgctaagaatgtggataagttcgcggagtggggtgtcaccgatttcgagatggctccgcaatacgtttctagcaccgacggtagctttttggatagcgtgattcaaaacggttatgcttttaccgaccgttacgacctgggcatcagcaagccgaacaaatatggcaccgcggacgatctggttaaagcgattaaggcattgcacagcaaaggcatcaaagttatggcggattgggttccggaccagatgtatgccctgccggaaaaagaggttgtgacggcaacccgtgttgacaaatacggtacgccggtagctggcagccagatcaaaaacacgctgtacgtggtcgatggtaaatctagcggtaaggaccagcaggcgaagtacggtggtgccttcctggaagagctgcaagcgaagtatccggaactgttcgcgcgcaaacagattagcaccggtgttccgatggacccgagcgtcaagattaagcaatggagcgcaaaatacttcaacggcacgaatatcctgggtcgtggtgctggttacgtgctgaaagatcaggcaaccaacacctactttaacatcagcgacaataaagagatcaatttcctgccaaagacgttgctgaaccaggattctcaagttggctttagctacgacggtaagggctatgtgtactacagcacctcgggctaccaggctaaaaacacgttcatcagcgagggtgacaagtggtattacttcgacaataacggttatatggttaccggcgcacagagcattaatggtgtgaactattacttcctgccgaatggtttacagctgcgtgatgcgattctgaaaaatgaggacggtacgtacgcgtattatggcaatgatggtcgccgctacgagaatggctattatcagtttatgagcggtgtttggcgccatttcaataatggcgagatgtccgttggtctgaccgtcattgacggtcaagttcaatactttgacgagatgggttaccaggcgaaaggcaaattcgttaccaccgcggatggtaagatccgttacttcgataagcagagcggcaatatgtatcgtaatcgtttcattgagaacgaagagggcaaatggctgtacctgggtgaggacggcgcggcagtcaccggtagccagacgatcaatggtcagcacctgtattttcgtgctaacggcgttcaggttaagggtgagttcgtgaccgatcgtcatggccgcatctcttattacgacggcaacagcggtgatcagatccgcaaccgtttcgtccgcaatgcgcaaggccagtggttttactttgacaacaatggctatgcagtaactggtgctcgtacgatcaacggccagcacctgtatttccgcgcgaacggtgttcaggtaaaaggtgagtttgttacggaccgccacggccgcattagctattatgatggtaatagcggtgaccaaattcgcaatcgtttcgtgcgtaatgcacagggtcagtggttctacttcgacaataatggttatgcagtcacgggtgcacgtaccattaacggccaacacctgtactttcgcgccaatggtgtgcaagtgaaaggcgaatttgttactgatcgttatggtcgtatcagctactatgatggcaattctggcgaccaaattcgcaatcgctttgttcgtaacgcccaaggtcaatggttctatttcgacaacaacggttacgcggtgaccggtgcccgcacgattaatggtcaacacttgtacttccgtgccaacggtgtccaggtgaagggtgaatttgtgaccgaccgctatggtcgcatttcttactacgacgcaaattccggtgaacgcgtccgtatcaattaa

SEQ ID NO: 11 - protein, 1313 aa, Streptococcus mutans
MIDGKYYYYDNNGKVRTNFTLIADGKILHFDETGAYTDTSIDTVNKDIVTTRSNLYKKYNQVYDRSAQSFEHVDHYLTAESWYRPKYILKDGKTWTQSTEKDFRPLLMTWWPSQETQRQYVNFMNAQLGINKTYDDTSNQLQLNIAAATIQAKIEAKITTLKNTDWLRQTISAFVKTQSAWNSDSEKPFDDHLQNGAVLYDNEGKLTPYANSNYRILNRTPTNQTGKKDPRYTADNTIGGYEFLLANDVDNSNPVVQAEQLNWLHFLMNFGNIYANDPDANFDSIRVDAVDNVDADLLQIAGDYLKAAKGIHKNDKAANDHLSILEAWSDNDTPYLHDDGDNMINMDNKLRLSLLFSLAKPLNQRSGMNPLITNSLVNRTDDNAETAAVPSYSFIRAHDSEVQDLIRDIIKAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKAMDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYALPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFNISDNKEINFLPKTLLNQDSQVGFSYDGKGYVYYSTSGYQAKNTFISEGDKWYYFDNNGYMVTGAQSINGVNYYFLPNGLQLRDAILKNEDGTYAYYGNDGRRYENGYYQFMSGVWRHFNNGEMSVGLTVIDGQVQYFDEMGYQAKGKFVTTADGKIRYFDKQSGNMYRNRFIENEEGKWLYLGEDGAAVTGSQTINGQHLYFRANGVQVKGEFVTDRHGRISYYDGNSGDQIRNRFVRNAQGQWFYFDNNGYAVTGARTINGQHLYFRANGVQVKGEFVTDRHGRISYYDGNSGDQIRNRFVRNAQGQWFYFDNNGYAVTGARTINGQHLYFRANGVQVKGEFVTDRYGRISYYDGNSGDQIRNRFVRNAQGQWFYFDNNGYAVTGARTINGQHLYFRANGVQVKGEFVTDRYGRISYYDANSGERVRIN

SEQ ID NO: 12 - DNA, 34 bp, artificial sequence
  primer
gggaattcccaggttgacggtaaatattattact

SEQ ID NO: 13 - DNA, 32 bp, artificial sequence
  primer
agatctagtcttagttccagccacggtacata

SEQ ID NO: 14 - protein, 1590 aa, Streptococcus sobrinus
MEKNVRFKMHKVKKRWVTLSVASATMLASALGASVASADTDTASDDSNQAVVTGDQTTNNQATDQTSIAATATSEQSASTDAATDQASAAEQTQGTTASTDTAAQTTTNANEAKWVPTENENQGFTDEMLAEAKNVATAESDSIPSDLAKMSNVKQVDGKYYYYDQDGNVKKNFAVSVGDKIYYFDETGAYKDTSKVDADKSSSAVSQNATIFAANNRAYSTSAKNFEAVDNYLTADSWYRPKSILKDGKTWTESGKDDFRPLLMAWWPDTETKRNYVNYMNKVVGIDKTYTAETSQADLTAAAELVQARIEQKITSENNTKWLREAISAFVKTQPQWNGESEKPYDDHLQNGALLFDNQTDLTPDTQSNYRLLNRTPTNQTGSLDSRFTYNPNDPLGGYDFLLANDVDNSNPVVQAEQLNWLHYLLNFGSIYANDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDIIRDIIKAEINPNSFGYSFTQEEIEQAFKIYNEDLKKTDKKYTHYNVPLSYTLLLTNKGSIPRVYYGDMFTDDGQYMANKTVNYDAIESLLKARMKYVSGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQVSNKYFNVASDTLFLPSSLLGKVVESGIRYDGKGYIYNSSATGDQVKASFITEAGNLYYFGKDGYMVTGAQTINGANYFFLENGTALRNTIYTDAQGNSHYYANDGKRYENGYQQFGNDWRYFKDGNMAVGLTTVDGNVQYFDKDGVQAKDKIIVTRDGKVRYFDQHNGNAATNTFIADKTGHWYYLGKDGVAVTGAQTVGKQKLYFEANGQQVKGDFVTSDEGKLYFYDVDSGDMWTDTFIEDKAGNWFYLGKDGAAVTGAQTIRGQKLYFKANGQQVKGDIVKGTDGKIRYYDAKSGEQVFNKTVKAADGKTYVIGNDGVAVDPSVVKGQTFKDASGALRFYNLKGQLVTGSGWYETANHDWVYIQSGKALTGEQTINGQHLYFKEDGHQVKGQLVTGTDGKVRYYDANSGDQAFNKSVTVNGKTYYFGNDGTAQTAGNPKGQTFKDGSDIRFYSMEGQLVTGSGWYENAQGQWLYVKNGKVLTGLQTVGSQRVYFDENGIQAKGKAVRTSDGKIRYFDENSGSMITNQWKFVYGQYYYFGNDGARIYRGWN

SEQ ID NO: 15 - DNA, 4308 bp, Streptococcus sobrinus
atggttgacggcaaatactactattatgatcaggacggtaacgtaaagaagaatttcgcggtgagcgttggtgacaaaatctactacttcgatgaaactggtgcatataaggataccagcaaagtggacgccgacaagagcagcagcgcggttagccaaaacgcgaccatctttgcggcgaataaccgtgcgtacagcacctctgcaaagaattttgaagcggtggataactacctgaccgcagacagctggtatcgtccgaaatccatcctgaaggacggcaaaacctggaccgagagcggtaaggatgatttccgtccactgctgatggcatggtggcctgacaccgaaactaagcgcaactacgtgaactatatgaataaagtggtcggtattgacaagacgtacactgcggaaacgtcgcaagcggatttgaccgcagcggcggagctggttcaagcgcgtatcgagcagaagattaccagcgaaaacaacaccaaatggctgcgcgaagcaatctccgcgttcgttaagacgcagcctcagtggaacggcgagtccgaaaagccgtatgacgatcacttgcagaacggtgcgctgctgtttgataaccaaaccgacctgacgccagacacccaaagcaattaccgtttgctgaaccgtaccccgaccaatcagactggtagcctggatagccgttttacgtataatccgaatgacccgttgggcggctacgatttcttgctggcgaacgacgttgacaatagcaatccggtcgtccaggctgaacagttgaactggctgcattatctgctgaactttggctctatttacgctaacgatgccgacgccaattttgacagcattcgcgttgatgccgtcgataatgtcgatgctgatctgctgcaaatcagcagcgattacctgaaagcagcgtatggcatcgacaagaataacaagaatgcgaacaaccatgttagcatcgtcgaagcgtggagcgacaatgataccccgtatttgcacgacgatggcgataatctgatgaacatggacaacaaatttcgcctgtccatgctgtggagcctggcaaagccgctggacaaacgtagcggtttgaacccgctgattcacaatagcctggtggaccgcgaggtggacgatcgtgaagtggaaaccgtgccgtcctacagctttgctcgtgcacatgatagcgaggtgcaggacatcatccgtgacattatcaaggctgagattaacccaaatagctttggttatagcttcactcaagaagagatcgagcaagcctttaagatttacaacgaggatttgaagaaaacggacaagaaatacacccactacaatgtgccgctgagctacaccctgctgctgaccaacaagggcagcatcccgcgtgtgtactatggtgatatgttcaccgatgatggccaatacatggcaaacaagaccgtcaactacgacgcaatcgagagcctgctgaaagcccgtatgaaatatgtcagcggtggccaagcaatgcagaactatcaaattggtaatggcgagattttgaccagcgtgcgctatggtaaaggtgccctgaagcagagcgataagggtgacgcgacgacgcgcactagcggtgttggcgtggttatgggtaatcagccgaacttctccctggacggtaaagttgtggccctgaatatgggtgcggcccatgcgaatcaagaataccgtgcactgatggtcagcactaaagacggtgtggcaacttacgcaaccgatgctgacgcatccaaagcgggcctggtcaagcgtaccgacgagaacggctacctgtacttcctgaatgatgatctgaagggcgtcgcgaaccctcaggtttccggcttcttgcaagtgtgggttccagttggtgccgccgatgaccaggacattcgcgtcgccgccagcgacacggcgagcacggatggtaaaagcctgcatcaagatgcggcgatggacagccgcgtcatgtttgagggtttcagcaattttcaatccttcgcgaccaaagaagaagaatacacgaatgttgttatcgcgaacaatgtcgataagttcgttagctggggtatcaccgattttgaaatggctccgcagtatgttagcagcaccgacggtcagttcttggacagcgtcatccagaatggctatgcgtttactgatcgctatgatctgggtatgtccaaggcgaacaagtatggcacggcagaccaactggttaaggcaatcaaagccctgcacgctaaaggcctgaaagttatggcggactgggtcccggatcaaatgtacacctttccaaaacaggaagttgtgaccgttacccgcaccgacaaattcggtaaaccgatcgccggctctcaaatcaatcacagcttgtatgtgaccgacaccaaatccagcggcgacgactaccaagcgaagtacggcggtgccttcctggatgaactgaaagaaaagtacccggaactgttcacgaaaaagcaaattagcacgggccaagcgattgatccgagcgtgaaaatcaagcagtggagcgcaaaatacttcaatggttcgaatatcctgggtcgcggtgcggactatgtgctgagcgaccaggtcagcaataagtatttcaacgtggcgagcgacaccttgttcctgccgtccagcctgctgggcaaggtcgtggagagcggcattcgttacgacggcaagggttacatctacaacagctccgcgaccggcgatcaggtcaaagcgtctttcattacggaagccggtaacctgtattacttcggcaaagacggttacatggttactggtgcccagacgattaatggcgccaactacttcttcctggaaaacggtacggcactgcgtaatacgatttacaccgatgctcaaggtaatagccactattacgcgaatgatggcaaacgctatgaaaatggctatcaacagttcggtaacgattggcgctactttaaagatggtaacatggcagtcggcctgaccacggttgatggcaacgtgcaatactttgacaaagacggcgtccaggcaaaggataagattatcgtcacccgtgatggcaaggtccgttacttcgatcagcacaacggtaacgcggcgaccaacacgttcattgctgataaaactggccattggtattacctgggtaaagatggcgtcgcggtgactggcgcccagaccgtcggcaaacaaaaactgtacttcgaggccaacggtcaacaagttaaaggtgactttgttacgtccgatgagggcaaactgtatttctatgacgttgattctggtgacatgtggacggacaccttcatcgaggataaggcgggcaactggttctatttgggcaaggatggtgcggcagttacgggtgcccaaacgattcgcggtcagaagctgtacttcaaggccaatggtcaacaggtcaagggtgacattgttaagggcaccgacggtaaaatccgctactatgatgcaaaatccggtgaacaggtgttcaacaaaacggtgaaagctgcggatggcaaaacgtatgttatcggtaatgatggtgtcgcggtggaccctagcgtggttaaaggtcaaacctttaaggacgcttcgggcgctctgcgtttctacaacttgaagggtcaactggtcactggcagcggctggtatgaaaccgcgaaccatgactgggtttacattcagtccggcaaggcactgaccggcgaacagaccattaacggtcaacacctgtatttcaaagaagatggtcaccaagtcaagggtcagttggtcacgggcaccgatggtaaagtgcgttactatgacgccaacagcggtgaccaagcattcaacaagagcgtcactgtgaatggtaaaacctattactttggcaacgatggtacggcgcagactgctggcaacccgaagggtcagacgttcaaggatggctccgacatccgtttttactctatggaaggccaactggtgaccggctcgggttggtacgagaacgcgcaaggccagtggctgtatgtgaaaaacggtaaggtgctgactggtctgcaaaccgttggcagccagcgtgtttacttcgacgagaatggtattcaggccaagggcaaagcagtgcgtaccagcgatggcaaaattcgttatttcgacgaaaacagcggcagcatgatcacgaatcaatggaagttcgtctatggtcagtattactactttggtaacgacggtgcacgtatttaccgtggttggaactaa

SEQ ID NO: 16 - protein, 1435 aa, Streptococcus sobrinus
MVDGKYYYYDQDGNVKKNFAVSVGDKIYYFDETGAYKDTSKVDADKSSSAVSQNATIFAANNRAYSTSAKNFEAVDNYLTADSWYRPKSILKDGKTWTESGKDDFRPLLMAWWPDTETKRNYVNYMNKVVGIDKTYTAETSQADLTAAAELVQARIEQKITSENNTKWLREAISAFVKTQPQWNGESEKPYDDHLQNGALLFDNQTDLTPDTQSNYRLLNRTPTNQTGSLDSRFTYNPNDPLGGYDFLLANDVDNSNPVVQAEQLNWLHYLLNFGSIYANDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDIIRDIIKAEINPNSFGYSFTQEEIEQAFKIYNEDLKKTDKKYTHYNVPLSYTLLLTNKGSIPRVYYGDMFTDDGQYMANKTVNYDAIESLLKARMKYVSGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQVSNKYFNVASDTLFLPSSLLGKVVESGIRYDGKGYIYNSSATGDQVKASFITEAGNLYYFGKDGYMVTGAQTINGANYFFLENGTALRNTIYTDAQGNSHYYANDGKRYENGYQQFGNDWRYFKDGNMAVGLTTVDGNVQYFDKDGVQAKDKIIVTRDGKVRYFDQHNGNAATNTFIADKTGHWYYLGKDGVAVTGAQTVGKQKLYFEANGQQVKGDFVTSDEGKLYFYDVDSGDMWTDTFIEDKAGNWFYLGKDGAAVTGAQTIRGQKLYFKANGQQVKGDIVKGTDGKIRYYDAKSGEQVFNKTVKAADGKTYVIGNDGVAVDPSVVKGQTFKDASGALRFYNLKGQLVTGSGWYETANHDWVYIQSGKALTGEQTINGQHLYFKEDGHQVKGQLVTGTDGKVRYYDANSGDQAFNKSVTVNGKTYYFGNDGTAQTAGNPKGQTFKDGSDIRFYSMEGQLVTGSGWYENAQGQWLYVKNGKVLTGLQTVGSQRVYFDENGIQAKGKAVRTSDGKIRYFDENSGSMITNQWKFVYGQYYYFGNDGARIYRGWN

SEQ ID NO: 17 - protein, 1570 aa, Streptococcus sp.
MKKNWVTIGVTALSMVTVAGGTLLEDQQVQADEQNAANQSGDSSQDLLREASATTNDTATTVAPTISADANTASVNIPVADATNTTTAATDRAAAPTTTAATVDTNSGQAAPSTNVQAAAADTSATPTDTNTNTNASVTATDRAVATDTANTEARTPSRRALAETREANTNTSTGIQWINGKQYYVNSDGSVRKNFVFEQDGKSYYFDAETGALATKSQDEFSTEPIKAAVDFSSGNQLYKNDNKSLDQLDTFITADAWYRPKSILKDGKTWTASTEADKRPLLMVWWPDKSTQVNYLNYMQNQGLGAGSFSTNSSQESLNLAAKAVQTKIEERIAREGNTNWLRTSIDQFIKTQPGWNSSTENSSYDHLQGGQLLFNNSKGDTGNRTSYANSDYRLLNRTPTNQSGTRKYFKDNSIGGLEFLLANDIDNSNPAVQAEQLNWLHFMMNIGSIMANDPTANFDGLRVDALDNVDADLLQIASDYFKAVYGVDKSEANAIKHLSYLEAWSANDPYYNKDTKGAQLPIDNALRNALTNLLMRDKNTRMQLGDMTAFMNSSLNPRGANDKNGERMANYIFTRAHDTEAQTIIQRIIRDRINPNLFGYNFTRDEIKKAFEIYNADINTAHKTYASYNLPSVYALMLTNKDSVTRVYYGDLYREDGHYMAKKTPYFDAIDTLLRARIKYVAGGQDMEVKKVGNDGLLTSVRYGKGANNSTDWGTTETRTQGMGVILTNNYDFRLGSNETVTMNMGRAHRNQLYRPLLLTTKDGLATYLNDSDVPSNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGRYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQVIKNEFVQDGNGNWYYFGADGKMTKGAQNINSKDYYFFDNGVQLRNALRRASNGYTYYYGLDGAMIKNAFVDFDDKHQQVRAFTTQGTMVVGNLHWSGHHFYFDRETGIQAKDRIVRTDDGKLHYYVAQTGDMGRNVFATDSRTGKRYYFDADGNTVTGSRVIDGKTYYFNQDGSVGTAYSNRADSIIFENGKARYITPAGEIGRSIFVYNPATKAWNYFDKEGNRVTGRQYIDGNLYYFKEDGSQVKGAIVEENGIKYYYEPGSGILASGRYLQVGDDQWIYFKHDGSLAIGQVRADGGYLKYFDKNGIQVKGQTIVEDGHTYYYDADSGALVTSSFAEIAPNQWAYFNTEGQALKGKWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYIPGR

SEQ ID NO: 18 - DNA, 4182 bp, Streptococcus sp.
atgatcaatggcaaacagtactatgtaaattcggacggtagcgtgcgtaagaatttcgtttttgaacaggatggtaagagctactactttgacgcggaaactggcgcgctggccactaaaagccaagatgaatttagcacggagccgattaaagcagcagtggacttctctagcggcaaccagctgtacaaaaatgacaacaaatcgctggatcagctggatacgtttatcaccgctgacgcatggtaccgccctaagtctattctgaaggatggcaaaacctggaccgcgtctaccgaagctgataagcgtccgttgctgatggtgtggtggccggacaagtccacccaagttaactacctgaactacatgcagaaccagggtttgggtgcgggtagcttcagcaccaatagcagccaagaatccctgaatctggctgcgaaagcagttcagaccaagatcgaagaacgcatcgcacgtgagggtaacaccaattggctgcgtaccagcattgaccaattcattaagacgcagccaggctggaacagcagcactgagaatagcagctatgatcacttgcagggtggtcaactgctgttcaataacagcaaaggtgatacgggtaaccgcaccagctatgcgaatagcgactatcgtctgctgaaccgtaccccaactaatcaaagcggcacccgtaagtactttaaggataattccatcggtggtctggaatttctgctggcaaacgacatcgacaacagcaaccctgccgttcaggcggagcagctgaactggctgcacttcatgatgaacattggttctatcatggcgaatgacccgacggcgaactttgatggtttgcgtgtggacgcgttggataacgtggatgcggacctgttgcagatcgcgagcgattacttcaaggcagtctacggtgttgataaatccgaggcgaatgcgatcaagcacctgagctatctggaggcgtggagcgccaatgacccgtattacaacaaggataccaaaggcgcgcaactgccgattgacaacgcgctgcgcaacgcactgaccaacctgttgatgcgtgacaagaatacgcgcatgcagctgggtgacatgacggcgtttatgaatagctctctgaacccacgtggtgcgaatgacaaaaacggcgagcgtatggcgaattacattttcacccgcgcacacgataccgaggcgcagaccatcattcagcgtattatccgcgatcgtatcaatccgaacctgtttggctacaatttcacccgcgatgaaatcaaaaaggcgtttgagatctacaacgcggacattaacacggcgcataagacgtacgcgagctacaatctgccgtccgtctacgcactgatgctgacgaataaggacagcgtgacccgtgtgtattacggtgacctgtatcgtgaggacggtcactacatggccaagaaaacgccttatttcgatgcaatcgataccctgctgcgtgcgcgcatcaaatacgtggcgggtggtcaagacatggaggtgaagaaagttggtaatgacggcttgctgacgagcgtccgctatggcaagggtgcgaacaatagcaccgactggggcacgactgaaacccgtacccaaggtatgggcgttatcctgacgaacaactatgatttccgcctgggcagcaacgaaaccgtcacgatgaacatgggccgtgcgcatcgcaatcagctgtatcgtccgctgctgctgacgaccaaggatggtctggccacgtacctgaatgatagcgacgtgccttcgaatttgctgaaacgcacggactggaatggtaacttgacctttaatgccaacgatgtgtttggtgtagagaacgtccaggtcagcggttacctgggtgtttgggtaccggttggtgctaaagctaaccaggatgcgcgtacccaaccgagcaaccgtgcgaacagcgatggtcaggtctataagtcgtctgcggcattggacagccaggtcatgtatgaggcgtttagcaattttcaggcatttgcggacgatcaaccggaactgtacatgaaccgcgttctggcgaagaacaccgatctgctgaaagcgtggggcgttactagcgttggcttgccgccacaatacgttagcagcaaagacggcaccttcctggatagcactattgataacggctatgcgttcgatgatcgttacgacatggcgctgagccagaacaacaaatacggttctctggaggacttgctgaacgttctgcgcgctctgcacaaagacggtattcaggcgattgcggactgggtcccggatcaaatctacaatttgccgggtaaagaggttgttaatgcgacgcgtgttaacggttacggttaccatcagcagggctaccagattgttgaccaggcgtacgttgcaaacacccgtacggatggtaccgattatcagggtcgttacggtggtgcttttctggacgaactgaaggcgaagtacccgagcattttcaatcgtgtccagattagcaacggtaaacagctgccaaccaatgagaaaatcacgaaatggtccgcgaaatacttcaatggcacgaacatcctgggccgtggtattaactatgtgctgcgcgacgacaagaccaatcagtatttcaacaccagcgcaaacggccaactgctgccgacgccactgcgcgacaccggtgccatcaccagcacgcaagttttccagcgtcgtggccaagacgtctattttctgcgtgataaccaggttatcaaaaacgagtttgtgcaagatggtaacggtaattggtactacttcggtgccgacggtaaaatgacgaagggtgcacaaaacatcaatagcaaggattactatttcttcgataatggcgtccagctgcgtaatgcgctgcgtcgcgcgtccaatggttacacctactattatggcctggacggtgccatgatcaagaacgctttcgtcgattttgatgataagcaccaacaggtgcgtgcgtttactacgcagggcacgatggtggtcggtaatttgcactggagcggtcaccacttctattttgaccgcgaaacgggtatccaagccaaagaccgcattgtgcgtaccgatgatggcaagctgcactattatgtcgcacaaaccggcgatatgggccgcaatgtgtttgcgaccgacagccgcacgggcaagcgctattactttgatgcggacggcaacaccgttacgggctcccgtgtcatcgacggcaagacctactacttcaaccaggacggttcggtcggtaccgcgtacagcaatcgtgcggatagcattatctttgagaatggcaaggctcgctatatcactccggctggcgagattggccgttccatttttgtctacaacccggcgaccaaagcgtggaattacttcgacaaggaaggtaaccgtgtcaccggtcgtcagtatattgacggcaatctgtactactttaaagaggacggctcccaagtgaaaggtgcgattgttgaagagaacggtatcaagtactactacgaaccgggcagcggtatcctggcgagcggtcgttatctgcaagtcggtgacgaccaatggatctacttcaaacacgacggtagcctggcgatcggtcaggttcgtgcagacggtggttacttgaaatactttgataagaatggcatccaggtcaagggccaaaccattgtggaggatggtcatacctattactacgatgccgactccggtgctctggtgacctctagcttcgcggagattgctccgaaccagtgggcctacttcaataccgagggccaagccctgaagggcaaatggaccatcaatggtaaagagtactattttgatcagaacggcattcagtataaaggcaaggcagttaaggtcggcagccgttacaaatactatgacgagaatgacggtcaaccggtcactaaccgttttgcccagattgagccgaacgtctgggcgtactttggtgccgatggctacgcagttactggcgaacaggtgattaatggccagcacctgtacttcgatcagtcgggtcgtcaggttaaaggtgcgtacgtcaccgtgaatggtcaacgtcgttactacgacgcaaacacgggtgaatacattccgggtcgttaa

SEQ ID NO: 19 - protein, 1393 aa, Streptococcus sp.
MINGKQYYVNSDGSVRKNFVFEQDGKSYYFDAETGALATKSQDEFSTEPIKAAVDFSSGNQLYKNDNKSLDQLDTFITADAWYRPKSILKDGKTWTASTEADKRPLLMVWWPDKSTQVNYLNYMQNQGLGAGSFSTNSSQESLNLAAKAVQTKIEERIAREGNTNWLRTSIDQFIKTQPGWNSSTENSSYDHLQGGQLLFNNSKGDTGNRTSYANSDYRLLNRTPTNQSGTRKYFKDNSIGGLEFLLANDIDNSNPAVQAEQLNWLHFMMNIGSIMANDPTANFDGLRVDALDNVDADLLQIASDYFKAVYGVDKSEANAIKHLSYLEAWSANDPYYNKDTKGAQLPIDNALRNALTNLLMRDKNTRMQLGDMTAFMNSSLNPRGANDKNGERMANYIFTRAHDTEAQTIIQRIIRDRINPNLFGYNFTRDEIKKAFEIYNADINTAHKTYASYNLPSVYALMLTNKDSVTRVYYGDLYREDGHYMAKKTPYFDAIDTLLRARIKYVAGGQDMEVKKVGNDGLLTSVRYGKGANNSTDWGTTETRTQGMGVILTNNYDFRLGSNETVTMNMGRAHRNQLYRPLLLTTKDGLATYLNDSDVPSNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGRYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQVIKNEFVQDGNGNWYYFGADGKMTKGAQNINSKDYYFFDNGVQLRNALRRASNGYTYYYGLDGAMIKNAFVDFDDKHQQVRAFTTQGTMVVGNLHWSGHHFYFDRETGIQAKDRIVRTDDGKLHYYVAQTGDMGRNVFATDSRTGKRYYFDADGNTVTGSRVIDGKTYYFNQDGSVGTAYSNRADSIIFENGKARYITPAGEIGRSIFVYNPATKAWNYFDKEGNRVTGRQYIDGNLYYFKEDGSQVKGAIVEENGIKYYYEPGSGILASGRYLQVGDDQWIYFKHDGSLAIGQVRADGGYLKYFDKNGIQVKGQTIVEDGHTYYYDADSGALVTSSFAEIAPNQWAYFNTEGQALKGKWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYIPGR

SEQ ID NO: 20 - DNA, 3351 bp, Paenibacillus humicus
atggctagcgcagcaggaggcgcgaatctgacgctcggcaaaaccgtcaccgccagcggccagtcgcagacgtacagccccgacaatgtcaaggacagcaatcagggaacttactgggaaagcacgaacaacgccttcccgcagtggatccaagtcgaccttggcgccagcacgagcatcgaccagatcgtgctcaaacttccgtccggatgggagactcgtacgcaaacgctctcgatacagggcagcgcgaacggctcgacgttcacgaacatcgtcggatcggccgggtatacattcaatccatccgtcgccggcaacagcgtcacgatcaacttcagcgctgccagcgcccgctacgtccgcctgaatttcacggccaatacgggctggccagcaggccagctgtcggagcttgagatctacggagcgacggcgccaacgcctactcccacgcctactccaacaccaacgccaacgccaacaccaacgccaacccctacagtaacccctgcgccttcggccacgccgactccgactcctccggcaggcagcaacatcgccgtagggaaatcgattacagcctcttccagcacgcagacctacgtagctgcaaatgcaaatgacaacaatacatccacctattgggagggaggaagcaacccgagcacgctgactctcgatttcggttccaaccagagcatcacttccgtcgtcctcaagctgaatccggcttcggaatgggggactcgcacgcaaacgatccaagttcttggagcggatcagaacgccggctccttcagcaatctcgtctctgcccagtcctatacgttcaatcccgcaaccggcaatacggtgacgattccggtctccgcgacggtcaagcgcctccagctgaacattacggcgaactccggcgcccctgccggccagattgccgagttccaagtgttcggcacgccagcgcctaatccggacttgaccattaccggcatgtcctggactccgtcttctccggtcgagagcggcgacattacgctgaacgccgtcgtcaagaacatcggaactgcagctgcaggcgccacgacggtcaatttctacctgaacaacgaactcgccggcaccgctccggtaggcgcgcttgcggcaggagcttctgcaaatgtatcgatcaatgcaggcgccaaagcagccgcaacgtatgcggtaagcgccaaagtcgacgagagcaacgccgtcatcgagcagaatgaaggcaacaacagctactcgaacccgactaacctcgtcgtagcgccggtgtccagctccgacctcgtcgccgtgacgtcatggtcgccgggcacgccgtcgcagggagcggcggtcgcatttaccgtcgcgcttaaaaatcagggtacgctggcttccgccggcggagcccatcccgtaaccgtcgttctgaaaaacgctgccggagcgacgctgcaaaccttcacgggcacctacacaggttccctggcagcaggcgcatccgcgaatatcagcgtgggcagctggacggcagcgagcggcacctataccgtctcgacgacggtagccgctgacggcaatgaaattccggccaagcaaagcaacaatacgagcagcgcgagcctcacggtctactcggcgcgcggcgccagcatgccgtacagccgttacgacacggaggatgcggtgctcggcggcggagctgtcctgagaacggcgccgacgttcgatcagtcgctcatcgcttccgaagcatcgggacagaaatacgccgcacttccgtccaacggctccagcctgcagtggaccgtccgtcaaggccagggcggtgcaggcgtcacgatgcgcttcacgatgcccgacacgagcgacggcatgggccagaacggctcgctcgacgtctatgtcaacggaaccaaagccaaaacggtgtcgctgacctcttattacagctggcagtatttctccggcgacatgccggctgacgctccgggcggcggcaggccgctcttccgcttcgacgaagtccacttcaagctggatacggcgttgaagccgggagacacgatccgcgtccagaagggcggtgacagcctggagtacggcgtcgacttcatcgagatcgagccgattccggcagcggttgcccgtccggccaactcggtgtccgtcaccgaatacggcgctgtcgccaatgacggcaaggatgatctcgccgccttcaaggctgccgtgaccgcagcggtagcggccggaaaatccctctacatcccggaaggcaccttccacctgagcagcatgtgggagatcggctcggccaccagcatgatcgacaacttcacggtcacgggtgccggcatctggtatacgaacatccagttcacgaatcccaatgcatcgggcggcggcatctccctgagaatcaaaggaaagctggatttcagcaacatctacatgaactccaacctgcgttcccgttacgggcagaacgccgtctacaaaggctttatggacaatttcggcactaattcgatcatccatgacgtctgggtcgagcatttcgaatgcggcatgtgggtcggcgactacgcccatactcctgcgatctatgcgagcgggctcgtcgtggaaaacagccgcatccgcaacaatcttgccgacggcatcaacttctcgcagggaacgagcaactcgaccgtccgcaacagcagcatccgcaacaacggcgatgacggcctcgccgtctggacgagcaacacgaacggcgctccggccggcgtgaacaacaccttctcctacaacacgatcgagaacaactggcgcgcggcggccatcgccttcttcggcggcagcggccacaaggctgaccacaactacatcatcgactgtgtcggcggctccggcatccggatgaatacggtgttcccaggctaccacttccagaacaacaccggcatcaccttctcggatacgacgatcatcaacagcggcaccagccaggatctgtacaacggcgagcgcggagcgattgatctggaagcatccaacgacgcgatcaaaaacgtcaccttcaccaacatcgacatcatcaatgcccagcgcgacggcgttcagatcggctatggcggcggcttcgagaacatcgtgttcaacaacatcacgatcgacggcaccggccgcgacgggatatcgacatcccgcttctcgggacctcatcttggcgcagccatctatacgtacacgggcaacggctcggcgacgttcaacaacctggtgacccggaacatcgcctatgcaggcggcaactacatccagagcgggttcaacctgacgatctaa

SEQ ID NO: 21 - protein, 1116 aa, Paenibacillus humicus
MASAAGGANLTLGKTVTASGQSQTYSPDNVKDSNQGTYWESTNNAFPQWIQVDLGASTSIDQIVLKLPSGWETRTQTLSIQGSANGSTFTNIVGSAGYTFNPSVAGNSVTINFSAASARYVRLNFTANTGWPAGQLSELEIYGATAPTPTPTPTPTPTPTPTPTPTPTVTPAPSATPTPTPPAGSNIAVGKSITASSSTQTYVAANANDNNTSTYWEGGSNPSTLTLDFGSNQSITSVVLKLNPASEWGTRTQTIQVLGADQNAGSFSNLVSAQSYTFNPATGNTVTIPVSATVKRLQLNITANSGAPAGQIAEFQVFGTPAPNPDLTITGMSWTPSSPVESGDITLNAVVKNIGTAAAGATTVNFYLNNELAGTAPVGALAAGASANVSINAGAKAAATYAVSAKVDESNAVIEQNEGNNSYSNPTNLVVAPVSSSDLVAVTSWSPGTPSQGAAVAFTVALKNQGTLASAGGAHPVTVVLKNAAGATLQTFTGTYTGSLAAGASANISVGSWTAASGTYTVSTTVAADGNEIPAKQSNNTSSASLTVYSARGASMPYSRYDTEDAVLGGGAVLRTAPTFDQSLIASEASGQKYAALPSNGSSLQWTVRQGQGGAGVTMRFTMPDTSDGMGQNGSLDVYVNGTKAKTVSLTSYYSWQYFSGDMPADAPGGGRPLFRFDEVHFKLDTALKPGDTIRVQKGGDSLEYGVDFIEIEPIPAAVARPANSVSVTEYGAVANDGKDDLAAFKAAVTAAVAAGKSLYIPEGTFHLSSMWEIGSATSMIDNFTVTGAGIWYTNIQFTNPNASGGGISLRIKGKLDFSNIYMNSNLRSRYGQNAVYKGFMDNFGTNSIIHDVWVEHFECGMWVGDYAHTPAIYASGLVVENSRIRNNLADGINFSQGTSNSTVRNSSIRNNGDDGLAVWTSNTNGAPAGVNNTFSYNTIENNWRAAAIAFFGGSGHKADHNYIIDCVGGSGIRMNTVFPGYHFQNNTGITFSDTTIINSGTSQDLYNGERGAIDLEASNDAIKNVTFTNIDIINAQRDGVQIGYGGGFENIVFNNITIDGTGRDGISTSRFSGPHLGAAIYTYTGNGSATFNNLVTRNIAYAGGNYIQSGFNLTI

SEQ ID NO: 22 - protein, 1146 aa, Paenibacillus humicus
MRIRTKYMNWMLVLVLIAAGFFQAAGPIAPATAAGGANLTLGKTVTASGQSQTYSPDNVKDSNQGTYWESTNNAFPQWIQVDLGASTSIDQIVLKLPSGWETRTQTLSIQGSANGSTFTNIVGSAGYTFNPSVAGNSVTINFSAASARYVRLNFTANTGWPAGQLSELEIYGATAPTPTPTPTPTPTPTPTPTPTPTVTPAPSATPTPTPPAGSNIAVGKSITASSSTQTYVAANANDNNTSTYWEGGSNPSTLTLDFGSNQSITSVVLKLNPASEWGTRTQTIQVLGADQNAGSFSNLVSAQSYTFNPATGNTVTIPVSATVKRLQLNITANSGAPAGQIAEFQVFGTPAPNPDLTITGMSWTPSSPVESGDITLNAVVKNIGTAAAGATTVNFYLNNELAGTAPVGALAAGASANVSINAGAKAAATYAVSAKVDESNAVIEQNEGNNSYSNPTNLVVAPVSSSDLVAVTSWSPGTPSQGAAVAFTVALKNQGTLASAGGAHPVTVVLKNAAGATLQTFTGTYTGSLAAGASANISVGSWTAASGTYTVSTTVAADGNEIPAKQSNNTSSASLTVYSARGASMPYSRYDTEDAVLGGGAVLRTAPTFDQSLIASEASGQKYAALPSNGSSLQWTVRQGQGGAGVTMRFTMPDTSDGMGQNGSLDVYVNGTKAKTVSLTSYYSWQYFSGDMPADAPGGGRPLFRFDEVHFKLDTALKPGDTIRVQKGGDSLEYGVDFIEIEPIPAAVARPANSVSVTEYGAVANDGKDDLAAFKAAVTAAVAAGKSLYIPEGTFHLSSMWEIGSATSMIDNFTVTGAGIWYTNIQFTNPNASGGGISLRIKGKLDFSNIYMNSNLRSRYGQNAVYKGFMDNFGTNSIIHDVWVEHFECGMWVGDYAHTPAIYASGLVVENSRIRNNLADGINFSQGTSNSTVRNSSIRNNGDDGLAVWTSNTNGAPAGVNNTFSYNTIENNWRAAAIAFFGGSGHKADHNYIIDCVGGSGIRMNTVFPGYHFQNNTGITFSDTTIINSGTSQDLYNGERGAIDLEASNDAIKNVTFTNIDIINAQRDGVQIGYGGGFENIVFNNITIDGTGRDGISTSRFSGPHLGAAIYTYTGNGSATFNNLVTRNIAYAGGNYIQSGFNLTIK

SEQ ID NO: 23 - DNA, 3426 bp, Paenibacillus humicus
gtgagaagcaaaaaattgtggatcagcttgttgtttgcgttaacgttaatctttacgatggcgttcagcaacatgtctgctagcgcagcaggaggcgcgaatctgacgctcggcaaaaccgtcaccgccagcggccagtcgcagacgtacagccccgacaatgtcaaggacagcaatcagggaacttactgggaaagcacgaacaacgccttcccgcagtggatccaagtcgaccttggcgccagcacgagcatcgaccagatcgtgctcaaacttccgtccggatgggagactcgtacgcaaacgctctcgatacagggcagcgcgaacggctcgacgttcacgaacatcgtcggatcggccgggtatacattcaatccatccgtcgccggcaacagcgtcacgatcaacttcagcgctgccagcgcccgctacgtccgcctgaatttcacggccaatacgggctggccagcaggccagctgtcggagcttgagatctacggagcgacggcgccaacgcctactcccacgcctactccaacaccaacgccaacgccaacaccaacgccaacccctacagtaacccctgcgccttcggccacgccgactccgactcctccggcaggcagcaacatcgccgtagggaaatcgattacagcctcttccagcacgcagacctacgtagctgcaaatgcaaatgacaacaatacatccacctattgggagggaggaagcaacccgagcacgctgactctcgatttcggttccaaccagagcatcacttccgtcgtcctcaagctgaatccggcttcggaatgggggactcgcacgcaaacgatccaagttcttggagcggatcagaacgccggctccttcagcaatctcgtctctgcccagtcctatacgttcaatcccgcaaccggcaatacggtgacgattccggtctccgcgacggtcaagcgcctccagctgaacattacggcgaactccggcgcccctgccggccagattgccgagttccaagtgttcggcacgccagcgcctaatccggacttgaccattaccggcatgtcctggactccgtcttctccggtcgagagcggcgacattacgctgaacgccgtcgtcaagaacatcggaactgcagctgcaggcgccacgacggtcaatttctacctgaacaacgaactcgccggcaccgctccggtaggcgcgcttgcggcaggagcttctgcaaatgtatcgatcaatgcaggcgccaaagcagccgcaacgtatgcggtaagcgccaaagtcgacgagagcaacgccgtcatcgagcagaatgaaggcaacaacagctactcgaacccgactaacctcgtcgtagcgccggtgtccagctccgacctcgtcgccgtgacgtcatggtcgccgggcacgccgtcgcagggagcggcggtcgcatttaccgtcgcgcttaaaaatcagggtacgctggcttccgccggcggagcccatcccgtaaccgtcgttctgaaaaacgctgccggagcgacgctgcaaaccttcacgggcacctacacaggttccctggcagcaggcgcatccgcgaatatcagcgtgggcagctggacggcagcgagcggcacctataccgtctcgacgacggtagccgctgacggcaatgaaattccggccaagcaaagcaacaatacgagcagcgcgagcctcacggtctactcggcgcgcggcgccagcatgccgtacagccgttacgacacggaggatgcggtgctcggcggcggagctgtcctgagaacggcgccgacgttcgatcagtcgctcatcgcttccgaagcatcgggacagaaatacgccgcacttccgtccaacggctccagcctgcagtggaccgtccgtcaaggccagggcggtgcaggcgtcacgatgcgcttcacgatgcccgacacgagcgacggcatgggccagaacggctcgctcgacgtctatgtcaacggaaccaaagccaaaacggtgtcgctgacctcttattacagctggcagtatttctccggcgacatgccggctgacgctccgggcggcggcaggccgctcttccgcttcgacgaagtccacttcaagctggatacggcgttgaagccgggagacacgatccgcgtccagaagggcggtgacagcctggagtacggcgtcgacttcatcgagatcgagccgattccggcagcggttgcccgtccggccaactcggtgtccgtcaccgaatacggcgctgtcgccaatgacggcaaggatgatctcgccgccttcaaggctgccgtgaccgcagcggtagcggccggaaaatccctctacatcccggaaggcaccttccacctgagcagcatgtgggagatcggctcggccaccagcatgatcgacaacttcacggtcacgggtgccggcatctggtatacgaacatccagttcacgaatcccaatgcatcgggcggcggcatctccctgagaatcaaaggaaagctggatttcagcaacatctacatgaactccaacctgcgttcccgttacgggcagaacgccgtctacaaaggctttatggacaatttcggcactaattcgatcatccatgacgtctgggtcgagcatttcgaatgcggcatgtgggtcggcgactacgcccatactcctgcgatctatgcgagcgggctcgtcgtggaaaacagccgcatccgcaacaatcttgccgacggcatcaacttctcgcagggaacgagcaactcgaccgtccgcaacagcagcatccgcaacaacggcgatgacggcctcgccgtctggacgagcaacacgaacggcgctccggccggcgtgaacaacaccttctcctacaacacgatcgagaacaactggcgcgcggcggccatcgccttcttcggcggcagcggccacaaggctgaccacaactacatcatcgactgtgtcggcggctccggcatccggatgaatacggtgttcccaggctaccacttccagaacaacaccggcatcaccttctcggatacgacgatcatcaacagcggcaccagccaggatctgtacaacggcgagcgcggagcgattgatctggaagcatccaacgacgcgatcaaaaacgtcaccttcaccaacatcgacatcatcaatgcccagcgcgacggcgttcagatcggctatggcggcggcttcgagaacatcgtgttcaacaacatcacgatcgacggcaccggccgcgacgggatatcgacatcccgcttctcgggacctcatcttggcgcagccatctatacgtacacgggcaacggctcggcgacgttcaacaacctggtgacccggaacatcgcctatgcaggcggcaactacatccagagcgggttcaacctgacgatctaa

SEQ ID NO: 24 - protein, 1141 aa, Paenibacillus humicus
MRSKKLWISLLFALTLIFTMAFSNMSASAAGGANLTLGKTVTASGQSQTYSPDNVKDSNQGTYWESTNNAFPQWIQVDLGASTSIDQIVLKLPSGWETRTQTLSIQGSANGSTFTNIVGSAGYTFNPSVAGNSVTINFSAASARYVRLNFTANTGWPAGQLSELEIYGATAPTPTPTPTPTPTPTPTPTPTPTVTPAPSATPTPTPPAGSNIAVGKSITASSSTQTYVAANANDNNTSTYWEGGSNPSTLTLDFGSNQSITSVVLKLNPASEWGTRTQTIQVLGADQNAGSFSNLVSAQSYTFNPATGNTVTIPVSATVKRLQLNITANSGAPAGQIAEFQVFGTPAPNPDLTITGMSWTPSSPVESGDITLNAVVKNIGTAAAGATTVNFYLNNELAGTAPVGALAAGASANVSINAGAKAAATYAVSAKVDESNAVIEQNEGNNSYSNPTNLVVAPVSSSDLVAVTSWSPGTPSQGAAVAFTVALKNQGTLASAGGAHPVTVVLKNAAGATLQTFTGTYTGSLAAGASANISVGSWTAASGTYTVSTTVAADGNEIPAKQSNNTSSASLTVYSARGASMPYSRYDTEDAVLGGGAVLRTAPTFDQSLIASEASGQKYAALPSNGSSLQWTVRQGQGGAGVTMRFTMPDTSDGMGQNGSLDVYVNGTKAKTVSLTSYYSWQYFSGDMPADAPGGGRPLFRFDEVHFKLDTALKPGDTIRVQKGGDSLEYGVDFIEIEPIPAAVARPANSVSVTEYGAVANDGKDDLAAFKAAVTAAVAAGKSLYIPEGTFHLSSMWEIGSATSMIDNFTVTGAGIWYTNIQFTNPNASGGGISLRIKGKLDFSNIYMNSNLRSRYGQNAVYKGFMDNFGTNSIIHDVWVEHFECGMWVGDYAHTPAIYASGLVVENSRIRNNLADGINFSQGTSNSTVRNSSIRNNGDDGLAVWTSNTNGAPAGVNNTFSYNTIENNWRAAAIAFFGGSGHKADHNYIIDCVGGSGIRMNTVFPGYHFQNNTGITFSDTTIINSGTSQDLYNGERGAIDLEASNDAIKNVTFTNIDIINAQRDGVQIGYGGGFENIVFNNITIDGTGRDGISTSRFSGPHLGAAIYTYTGNGSATFNNLVTRNIAYAGGNYIQSGFNLTI

SEQ ID NO: 25 - protein, 26 aa, Bacillus subtilis
MRSKKLWISLLFALTLIFTMAFSNMS

SEQ ID NO: 26 - DNA, 1308 bp, Penicillium marneffei
atgaagcaaaccacttccctcctcctctcagccatcgcggcaaccagcagcttcagcggactaacagccgctcaaaaactcgcctttgcgcacgtcgtcgtcggcaacactgcagcacacacccaatccacctgggaaagcgacattactctcgcccataactccggtctagatgcctttgccttgaacggtggattccccgatggcaacatccccgcacaaatcgccaacgcttttgcggcttgtgaagccctttcaaatggcttcaagctattcatttcgtttgactacctcggtggtggtcagccctggcctgcctcagaggttgtgtctatgctgaagcagtatgccagttccgattgttatttggcctatgatggcaagccctttgtctcaacttttgagggcaccggaaatattgcggattgggcgcacggaggtcccattcggtcggcggtggatgtttactttgtgccggattggacgagtttggggcctgctgggattaagtcgtatctcgacaatatcgatggatttttcagctggaacatgtggcctgtaggtgcggccgatatgaccgacgagcctgatttcgaatggctcgatgcaattgggtccgacaagacgtacatgatgggcgtttcgccatggttcttccacagtgcaagcggaggcaccgactgggtctggcgtggtgatgacctctgggatgaccgatggattcaagtcacctgcgtcgaccctcaatttgtccaggtcgtcacatggaacgactggggtgaatcctcctacatcggccccttcgtgaccgctagcgaagtccccgccggctcattagcctacgtcgacaacatgtcacaccaaagcttccttgacttcttgcctttctacatcgccaccttcaaaggcgacacattcaacatctcccgcgaccagatgcaatactggtaccgcctcgcacccgccgcagcaggcagcgcgtgcggcgtatacggcaatgatcccgatcaaggccagactaccgttgacgtcaactccatcgttcaggacaaggtgtttttcagtgctttgttgacggctgatgctactgtaacggtgcagattggtagtaatgctgcggtttcatatgatggtgttgctggtatgaaccactggagtcaggactttaatggccagaccggcgcggttacgtttagtgttgtcaggggtggcgctacagttaagagtggtattggagccgagattacggcttcgacttcgttgtcgaatgggtgcactaattacaacccttgggttggtagtttctaa

SEQ ID NO: 27 - protein, 435 aa, Penicillium marneffei
MKQTTSLLLSAIAATSSFSGLTAAQKLAFAHVVVGNTAAHTQSTWESDITLAHNSGLDAFALNGGFPDGNIPAQIANAFAACEALSNGFKLFISFDYLGGGQPWPASEVVSMLKQYASSDCYLAYDGKPFVSTFEGTGNIADWAHGGPIRSAVDVYFVPDWTSLGPAGIKSYLDNIDGFFSWNMWPVGAADMTDEPDFEWLDAIGSDKTYMMGVSPWFFHSASGGTDWVWRGDDLWDDRWIQVTCVDPQFVQVVTWNDWGESSYIGPFVTASEVPAGSLAYVDNMSHQSFLDFLPFYIATFKGDTFNISRDQMQYWYRLAPAAAGSACGVYGNDPDQGQTTVDVNSIVQDKVFFSALLTADATVTVQIGSNAAVSYDGVAGMNHWSQDFNGQTGAVTFSVVRGGATVKSGIGAEITASTSLSNGCTNYNPWVGSF

SEQ ID NO: 28 - DNA, 1929 bp, Aspergillus nidulans
atgaagctcagcacatttctctctgctctgggagctcttccccagctgatctcggctgccccgaatgcagtcgctaacaaacccaggcagtcctcggacgaccggcttgtctttgctcacttcatgattggaatcgtcagcaaccgcaattccgcagccgactacgacgatgatatgaaacgtgccaagtctctcggaatcgatgctttcgcgttgaacatcggggttgatccctacaccgaccagcaactcaatctcgcctatcagtccgctgccaacaatgacatgaaagtcttcatatcgttcgatttcaactggtataacaccggccaaggataccaggttgggcagaagatcgcccaatacgcgaacctcccagcgcagcttaaggtcgacggcaaagtctttgtctcctcgtttgcaggggacggtcttgatatcgcggcgatgcgtcaggccgccggacaggacatctactgggctccaaactaccatccagagtacggcactaacctggatggtgtcgatggcttgctcaattggatggcttggcctaatgatggcaacaacaaggcaccgcgtcctggagcctccgtttcggtggaagagggcgatgagatgtatatcagaactggaaaggactacattgctcctgcttctccctggttcttcacccatttcggccctgaagtcccgtacagcaagaactgggtcttccctggagatttgttgtggtatgaccgctggcagcaactgttgaccatgggcccacgattcatcgagatcgtcacctggaacgattacggcgagtcgcactatatcggcccattgagctcacctcacactgatgatggggcatccaagtgggtgaatgacatgccccatgatggatggatggatatgtctaagccgttcatcgccgcgtacaaggacggcgccacctcggttgatgactatatcaccgaagaccttctcgtgtactggtatcgcccggctccccgtgatgtcaactgcgatgccacagatacttgcatggtccccgccaacaatgccagtggcaattacttctatggccgcccgaatggctgggaaacgatggaagacgctgtgttcgtggtcaccaccctgactgagcccgccactgtgacggtcaattctggaggcaatgtcgaggtctttgatgcgcccgctggagccagcgctttcaaggtcccgatgggcgtgggctcgcaggcgttttcgctcagtcgtaacggacaggtcatccagtcggatatcagtcttctgcccatcattgatggctgcgtttgcggactgtacaatttcaatccttacgttgggtctctcccgccgagtcctattgactctctcgagcccgcaggtctctacagtctcacgcaaggccttcatgtacaaacgtgtttgccaacgccttcactcggcaagacaaccccaacaccgcctccaggctggggagctgctccaacgactacaaggacctcgtctacaaccggcacgaccggcacaactacaagaaccacgcggacgaccacgcgcaccacgacgacgagaccaaccaccagtaccagcactagcacaaccaccaggacaacgacaaccaccagaccaaccacaaccacccggacgacgacaaccacaaacccaaccggcggcaccggaaatgtctgcgtcgccggcacaggaccgggcaactatgtcggtctatgcagtttctgctgcaacttcggttactgccctccaggaccatgcacctgtacggcctatggagcgcccgtgccgacgccgccgacgacgggtgtccggggtgtgccgctgccgtggctggagaactataactcgtacctggggctatgcagctttgcttgtgatcacggatactgtccgccgactgcctgccaggttgcttaa

SEQ ID NO: 29 - protein, 642 aa, Aspergillus nidulans
MKLSTFLSALGALPQLISAAPNAVANKPRQSSDDRLVFAHFMIGIVSNRNSAADYDDDMKRAKSLGIDAFALNIGVDPYTDQQLNLAYQSAANNDMKVFISFDFNWYNTGQGYQVGQKIAQYANLPAQLKVDGKVFVSSFAGDGLDIAAMRQAAGQDIYWAPNYHPEYGTNLDGVDGLLNWMAWPNDGNNKAPRPGASVSVEEGDEMYIRTGKDYIAPASPWFFTHFGPEVPYSKNWVFPGDLLWYDRWQQLLTMGPRFIEIVTWNDYGESHYIGPLSSPHTDDGASKWVNDMPHDGWMDMSKPFIAAYKDGATSVDDYITEDLLVYWYRPAPRDVNCDATDTCMVPANNASGNYFYGRPNGWETMEDAVFVVTTLTEPATVTVNSGGNVEVFDAPAGASAFKVPMGVGSQAFSLSRNGQVIQSDISLLPIIDGCVCGLYNFNPYVGSLPPSPIDSLEPAGLYSLTQGLHVQTCLPTPSLGKTTPTPPPGWGAAPTTTRTSSTTGTTGTTTRTTRTTTRTTTTRPTTSTSTSTTTRTTTTTRPTTTTRTTTTTNPTGGTGNVCVAGTGPGNYVGLCSFCCNFGYCPPGPCTCTAYGAPVPTPPTTGVRGVPLPWLENYNSYLGLCSFACDHGYCPPTACQVA

SEQ ID NO: 30 - DNA, 22 bp, artificial sequence
  primer
caccatgtttggtcttgtccgc

SEQ ID NO: 31 - DNA, 20 bp, artificial sequence
  primer
tcagcagtactggcatgctg

SEQ ID NO: 32 - DNA, 20 bp, artificial sequence
  primer
  misc_feature (3)..(3): n is a, c, g, or t
gtnttytgycayttyatgat

SEQ ID NO: 33 - DNA, 27 bp, artificial sequence
  primer
  misc_feature (3)..(3): n is a, c, g, or t
  misc_feature (25)..(25): n is a, c, g, or t
gtnttytgyacayttyatgathggnat

SEQ ID NO: 34 - DNA, 23 bp, artificial sequence
  primer
gaytaygaygaygayatgcarcg

SEQ ID NO: 35 - DNA, 32 bp, artificial sequence
  primer
  misc_feature (12)..(12): n = inosine
  misc_feature (15)..(15): n = inosine
  misc_feature (18)..(18): n = inosine
  misc_feature (21)..(21): n = inosine
  misc_feature (30)..(30): n is a, c, g, or t
gtrcayttrcanggnccnggnggrcartancc

SEQ ID NO: 36 - DNA, 24 bp, artificial sequence
  primer
  misc_feature (4)..(4): n = inosine
  misc_feature (7)..(7): n = inosine
  misc_feature (10)..(10): n is a, c, g, or t
  misc_feature (13)..(13): n is a, c, g, or t
  misc_feature (19)..(19): n is a, c, g, or t
ytcnccnggnagnggrcanccrtt

SEQ ID NO: 37 - DNA, 30 bp, artificial sequence
  primer
  misc_feature (13)..(13): n = inosine
rcartaytgrcangcygtyggyggrcarta

SEQ ID NO: 38 - DNA, 20 bp, artificial sequence
  primer
ccccctggccaagtatgtgt

SEQ ID NO: 39 - DNA, 20 bp, artificial sequence
  primer
gtacgcaaagttgagctgct

SEQ ID NO: 40 - DNA, 20 bp, artificial sequence
  primer
agcacatcgctgatggatat

SEQ ID NO: 41 - DNA, 20 bp, artificial sequence
  primer
aagtatacgttgcttccggc

SEQ ID NO: 42 - DNA, 20 bp, artificial sequence
  primer
ctgacgatcggactrcacgt

SEQ ID NO: 43 - DNA, 20 bp, artificial sequence
  primer
cgttgtcgacgtagagctgt

SEQ ID NO: 44 - DNA, 20 bp, artificial sequence
  primer
acgatcggcagagtcatagg

SEQ ID NO: 45 - DNA, 20 bp, artificial sequence
  primer
atcggattgcatgtcacgac

SEQ ID NO: 46 - DNA, 20 bp, artificial sequence
  primer
tacatccagaccgtcaccag

SEQ ID NO: 47 - DNA, 20 bp, artificial sequence
  primer
acgtttgctcttgcggtatc

SEQ ID NO: 48 - DNA, 20 bp, artificial sequence
  primer
tcattatcccaggcctaaaa

SEQ ID NO: 49 - DNA, 21 bp, artificial sequence
  primer
caccatgctaggcattctccg

SEQ ID NO: 50 - DNA, 20 bp, artificial sequence
  primer
tcagcagtattggcatgccg

SEQ ID NO: 51 - DNA, 21 bp, artificial sequence
  primer
caccatgttgggcgtttttcg

SEQ ID NO: 52 - DNA, 20 bp, artificial sequence
  primer
ctagcagtattgrcatgccg

SEQ ID NO: 53 - DNA, 1908 bp, Hypocrea tawa
atgttgggcgtttttcgccgcctcgggctcggctcccttgccgccgcagctctgtcttctctcggcactgccgctcccgccaatgttgctattcggtctctcgaggaacgtgcttcttctgccgaccgtctcgtattctgtcacttcatgattggtattgttggtgaccgtggcagctcggcagactatgatgatgatatgcaacgtgccaaagccgctggcattgacgccttcgctctgaatatcggcgttgacggctataccgaccagcagcttgggtatgcctatgactctgccgatcgtaatggcatgaaagtcttcatttcattcgatttcaattggtggagccccggcaatgcagttggtgttggccagaagattgcgcagtatgccaaccgtcccgcccagctatatgtcgataaccgtccattcgcctcttccttcgctggtgacggtctggatgtaaatgcgttgcgcaatgctgcaggctccaacgtttactttgtgcccaacttccaccctggtcaatcttctccctcaaacattgacggcgccctgaactggatggcctgggataatgatggaaacaacaaggcacccaagcaaggccagacagtcacggtggcagacggcgacaacgcctacaagaattggttaggtggcaagccttacctagcacctgtctcaccttggtttttcacccatttcggccccgaagtttcatattccaagaactgggttttcccaggtggtgctctgatctataaccggtggcaacaggtcttgcagcaaggcttccccatggttgagattgttacatggaatgactacggcgagtctcactacgtcggcccacttaagtctaagcatttcgacgatggcaactccaaatgggtcaatgatatgccccatgatggattcctggatctttcaaagccgttcattgctgcttataagaacagggatactgacatctccaagtatgttcagaatgagcagcttgtctactggtaccgccgcaacttaaaggcactggactgcgacgccaccgacaccacctctaaccgcccggctaataatggaagcggtaattactttatgggacgccctgatggttggcaaaccatggatgatactgtttatgttgccgcacttctcaagactgccggttctgttacggtcacgtctggcggcaccactcaaacgttccagggcaacgccggagccaacctcttccaaatcccagccagcatcggccagcaaaagtttgctctaactcgtaacggtcagaccgtctttagcggaacctcattgatggatatcaccaacgtttgctcttgcggtatctacaacttcaacccatatgtgggtaccattcctgccggcttcgacgaccctcttcaggctgacggtcttttctctttgaccatcggattgcatgtcacgacttgtcaggccaagccatctcttggaaccaatcctcctgtcacttctggccctgtgtcctcgcttccagcttcctccactacccgcgcatcctcgcctcctgtttcttcaactcgcgtctcttccccccctgtctcttcccctccagttacttctcgcacctcttcttctcctccccctccggccagcagcacgccgtcatcgggtcaggtttgcgttgccggaaccgttgctgacggcgagtctggcaactacatcggcctgtgccaattcagctgcaactacggttactgcccaccaggaccgtgcaagtgcaccgcctttggcgctcccatctcgccaccggcaagcaatgggcgcaatggctgccctctaccgggcgaaggagatggttatctgggcctgtgcagtttcagttgtaaccataattactgccccccaacggcatgccaatactgctag

SEQ ID NO: 54 - protein, 635 aa, Hypocrea tawa
MLGVFRRLGLGSLAAAALSSLGTAAPANVAIRSLEERASSADRLVFCHFMIGIVGDRGSSADYDDDMQRAKAAGIDAFALNIGVDGYTDQQLGYAYDSADRNGMKVFISFDFNWWSPGNAVGVGQKIAQYANRPAQLYVDNRPFASSFAGDGLDVNALRNAAGSNVYFVPNFHPGQSSPSNIDGALNWMAWDNDGNNKAPKQGQTVTVADGDNAYKNWLGGKPYLAPVSPWFFTHFGPEVSYSKNWVFPGGALIYNRWQQVLQQGFPMVEIVTWNDYGESHYVGPLKSKHFDDGNSKWVNDMPHDGFLDLSKPFIAAYKNRDTDISKYVQNEQLVYWYRRNLKALDCDATDTTSNRPANNGSGNYFMGRPDGWQTMDDTVYVAALLKTAGSVTVTSGGTTQTFQGNAGANLFQIPASIGQQKFALTRNGQTVFSGTSLMDITNVCSCGIYNFNPYVGTIPAGFDDPLQADGLFSLTIGLHVTTCQAKPSLGTNPPVTSGPVSSLPASSTTRASSPPVSSTRVSSPPVSSPPVTSRTSSSPPPPASSTPSSGQVCVAGTVADGESGNYIGLCQFSCNYGYCPPGPCKCTAFGAPISPPASNGRNGCPLPGEGDGYLGLCSFSCNHNYCPPTACQYC

SEQ ID NO: 55 - DNA, 1884 bp, Trichoderma konilangbra
atgctaggcattctccgccgtctcgcgctcggcgccctcgccgccgcggccctctctcctctcgtcgtcgccgcgcctgccaatgtcgccatccgctccctcgaggaacgggcgagtagcgcagacaggctcgtgttctgccacttcatgattgggatatgcggtgatcgcggctccagcactgattatgacgacgatatgcaaagggccaaggcagcgggcatcgacgcgtttgcgttgaacattggcgtcgatggatacacggaccagcagctcaactttgcgtacgacgccgccgaccgcgccgggatgaaggtgttcatctccttcgacttcaactggtggagccccggcaacgcagtaggcgtcggccagaagattgcccaatacgcgtcgcggcccgcacagctctacgtcgacaaccggccctttgcgtcgtcgtttgccggcgatggccttgacgtgaatgcgctgcgcaacgccgccggaagcaacgtatactttgtgcccaacttccaccccgggcagtcctccccgtcaaccatcgacggggccctcaactggatggcctgggacaatgacggaaacaacaaggcccccaagcccggccgcaacgtcaccgtcgccgacggcgacaactcgtaccgtagctggctgggcggcaagccctacctggcccccgtttcgccctggttcttcacccacttcggccccgaggtttccttcagcaagaactgggtcttcccgggcggctcgctcctctacgaccgctggcaggacgtgctgcrccagggccccgaaatggtcgagatcatcacctggaacgattacggtgagagccactacaccgggcccctcaaaagtcgccactatgacgacggaaactcgaaatggaccaacgacatgccgcacgacggattcctggacctgtcgaaaccgtttatagcggcgtacaagaaccgcgacacgaacgtggcacggtacgtccagtccgaccagctcgtctactggtacagaaggacgctcaaggggctggactgcgacgcgactgacacgacgtcaaaccggcccgcgaacaacgccagcggcaactacttcatgggccggcccgacgggtggcagacgatggacgacaccgtgtacgtggtggcgctrctcacggccgcgggaactgtgacggtgacgtccggcggggccacccagacgttccagggcaccrccggagccaacctgttcgaggtcccggccaacctgggccagcagaagtttgccctgtcccgcaacgggcagaccgtcttcagcagcacatcgctgatggatatcgctaatgtgtgcccgtgcggcctctacaacttcaacccgtatgtcgggactgtcccgcccggttttgacgacccgctgcaggctgatggccttgcgtcgctgacgatcggactgcacgtcacgacctgtcaggccagaccctccctgggaacgaacccgcccatcacttccggccccggctcctcggtgcccgcttcaaccacccgctcgacttctccgcccggttccacgagccgcttctcgtcgaccccggtttcgtcccgctccatctcttcgacgccaccggtcagcacgccgccccctggccaagtatgtgtggccggcacagtcgctgacggccagtcgggcaactatattggcctatgcaacttcagctgcaacttcggctactgtcctcccggcccttgcaagtgcaccgcctttggcgctcccatcaacccaccggcgaccaatgggcgaaacggatgccccttgcctggagaggatgatagttacttgggcctctgcagcttcagttgcaaccataactactgccctccgacggcatgccaatactgctga

SEQ ID NO: 56 - protein, 627 aa, Trichoderma konilangbra
  MISC_FEATURE (263)..(263): Xaa = Arg or His
  MISC_FEATURE (407)..(407): Xaa = Thr or Ala
MLGILRRLALGALAAAALSPLVVAAPANVAIRSLEERASSADRLVFCHFMIGICGDRGSSTDYDDDMQRAKAAGIDAFALNIGVDGYTDQQLNFAYDAADRAGMKVFISFDFNWWSPGNAVGVGQKIAQYASRPAQLYVDNRPFASSFAGDGLDVNALRNAAGSNVYFVPNFHPGQSSPSTIDGALNWMAWDNDGNNKAPKPGRNVTVADGDNSYRSWLGGKPYLAPVSPWFFTHFGPEVSFSKNWVFPGGSLLYDRWQDVLXQGPEMVEIITWNDYGESHYTGPLKSRHYDDGNSKWTNDMPHDGFLDLSKPFIAAYKNRDTNVARYVQSDQLVYWYRRTLKGLDCDATDTTSNRPANNASGNYFMGRPDGWQTMDDTVYVVALLTAAGTVTVTSGGATQTFQGTXGANLFEVPANLGQQKFALSRNGQTVFSSTSLMDIANVCPCGLYNFNPYVGTVPPGFDDPLQADGLASLTIGLHVTTCQARPSLGTNPPITSGPGSSVPASTTRSTSPPGSTSRFSSTPVSSRSISSTPPVSTPPPGQVCVAGTVADGQSGNYIGLCNFSCNFGYCPPGPCKCTAFGAPINPPATNGRNGCPLPGEDDSYLGLCSFSCNHNYCPPTACQYC

SEQ ID NO: 57 - DNA, 1869 bp, Trichoderma reesei
atgtttggtcttgtccgccgactcggggtcggcgcccttgtcgccgcagccctttcctccctcgctgccgccgcgccagccaacgtcgccatccgctccctcgaggaacgggctagcagcgcagatagacttgtgttttgccactttatgattgggatatgtggtgatcgcacctccagtaccgattatgatgatgatatgcagcgagccaaggccgcgggcattgacgcctttgcccttaacattggtgtcgacggatacacggaccagcagctcaactttgcctacgacgccgctgatcgcgccgggatgaaggtgttcatctcctttgacttcaactggtggagccccggcaacgcggcaggcgtcggccagaagattgcccaatatgcgtcgcggcccgcacagctctacgtcgacaaccgtccctttgcatcgtcgtttgccggtgacggccttgacgtgaatacgctgcggaatgcggccggcagcaacgtgtactttgtgcccaacttccaccccgggcagtcgtcgccgtccaccatcgacggggctctgaactggatggcctgggacaacgacggcaacaacaaggcccccaagcccggccaaaacgtcacagtcgccgacggcgacaactcctaccgcagctggctcgccggcaagccctacctcgcccccgtctcgccctggttcttcacccacttcggcccagaggtatcgtacagtaagaactgggtcttccctggcggctccctgtggtacgaccgctggcaggacgtgctgcgccagggcttcgagatggtcgaaatcgtcacctggaacgattacggtgagagccactacacggggcccctggaaagtcgacactatgacgacggaaactcgaaatggaccaacgacatgccgcacgacggcttcctggacctggcgaagccattcattgccgcgtacaagaaccgcgacacggacgtggcgccctacatccagaatgagcagctgatctactggtatcggcggaatctcaaggggctggactgcgacgcgaccgacacgacgtcgaaccgcccggcgaacaacggcagcggcaactacttcatgggtcggcccgacgggtggcagacgatggacgacacggtgtatgtggtggcgctgctcaagagcgcgggcacggtgacggtgacgtcgggcggcgccacgcagacgttccagggcaccgccggcgccaacctgttcgaggtcccagccaaccttgggcagcagaagtttgccctgtcccgcaacgggcagaccgtcttcagcagcacgtcgctgatggatatcaccaatgtgtgcccgtgcggcatctacaacttcaacccgtatgtcgggactgtgcccgctggctttgacgacccgctcgggcccgatggccttgcttctttgacaatcggactgcacgtcacgacttgtcaggccaagccgtcgctggggaccaacccgcccatcacttccggccccggctcctcggtgcccgtttccactccgcccggttccacgacccgcttctcgtcaacgccggtttcatctcgctccagctcgtccacgccgccggttagcacgccgccgcctggccaagtctgtgtcgccggtacggtggctgacggccagtccggcaactatattggcctctgcaacttcagctgcaacttcgggtactgtccccccggaccctgcaagtgcactgcctacggcgctccgatcaacccaccagcaacgaatgggcgaaatgggtgccccttgcctggagaagacgatagttatctgggcctctgcagcttcagctgcaaccacaattactgtccgccaacagcatgccagtactgctga

SEQ ID NO: 58 - protein, 622 aa, Trichoderma reesei
MFGLVRRLGVGALVAAALSSLAAAAPANVAIRSLEERASSADRLVFCHFMIGICGDRTSSTDYDDDMQRAKAAGIDAFALNIGVDGYTDQQLNFAYDAADRAGMKVFISFDFNWWSPGNAAGVGQKIAQYASRPAQLYVDNRPFASSFAGDGLDVNTLRNAAGSNVYFVPNFHPGQSSPSTIDGALNWMAWDNDGNNKAPKPGQNVTVADGDNSYRSWLAGKPYLAPVSPWFFTHFGPEVSYSKNWVFPGGSLWYDRWQDVLRQGFEMVEIVTWNDYGESHYTGPLESRHYDDGNSKWTNDMPHDGFLDLAKPFIAAYKNRDTDVAPYIQNEQLIYWYRRNLKGLDCDATDTTSNRPANNGSGNYFMGRPDGWQTMDDTVYVVALLKSAGTVTVTSGGATQTFQGTAGANLFEVPANLGQQKFALSRNGQTVFSSTSLMDITNVCPCGIYNFNPYVGTVPAGFDDPLGPDGLASLTIGLHVTTCQAKPSLGTNPPITSGPGSSVPVSTPPGSTTRFSSTPVSSRSSSSTPPVSTPPPGQVCVAGTVADGQSGNYIGLCNFSCNFGYCPPGPCKCTAYGAPINPPATNGRNGCPLPGEDDSYLGLCSFSCNHNYCPPTACQYC

SEQ ID NO: 59 - DNA, 8616 bp, artificial sequence
  plasmid pTrex
aagcttaactagtacttctcgagctctgtacatgtccggtcgcgacgtacgcgtatcgatggcgccagctgcaggcggccgcctgcagccacttgcagtcccgtggaattctcacggtgaatgtaggccttttgtagggtaggaattgtcactcaagcacccccaacctccattacgcctcccccatagagttcccaatcagtgagtcatggcactgttctcaaatagattggggagaagttgacttccgcccagagctgaaggtcgcacaaccgcatgatatagggtcggcaacggcaaaaaagcacgtggctcaccgaaaagcaagatgtttgcgatctaacatccaggaacctggatacatccatcatcacgcacgaccactttgatctgctggtaaactcgtattcgccctaaaccgaagtgcgtggtaaatctacacgtgggcccctttcggtatactgcgtgtgtcttctctaggtgccattcttttcccttcctctagtgttgaattgtttgtgttggagtccgagctgtaactacctctgaatctctggagaatggtggactaacgactaccgtgcacctgcatcatgtatataatagtgatcctgagaaggggggtttggagcaatgtgggactttgatggtcatcaaacaaagaacgaagacgcctcttttgcaaagttttgtttcggctacggtgaagaactggatacttgttgtgtcttctgtgtatttttgtggcaacaagaggccagagacaatctattcaaacaccaagcttgctcttttgagctacaagaacctgtggggtatatatctagagttgtgaagtcggtaatcccgctgtatagtaatacgagtcgcatctaaatactccgaagctgctgcgaacccggagaatcgagatgtgctggaaagcttctagcgagcggctaaattagcatgaaaggctatgagaaattctggagacggcttgttgaatcatggcgttccattcttcgacaagcaaagcgttccgtcgcagtagcaggcactcattcccgaaaaaactcggagattcctaagtagcgatggaaccggaataatataataggcaatacattgagttgcctcgacggttgcaatgcaggggtactgagcttggacataactgttccgtaccccacctcttctcaacctttggcgtttccctgattcagcgtacccgtacaagtcgtaatcactattaacccagactgaccggacgtgttttgcccttcatttggagaaataatgtcattgcgatgtgtaatttgcctgcttgaccgactggggctgttcgaagcccgaatgtaggattgttatccgaactctgctcgtagaggcatgttgtgaatctgtgtcgggcaggacacgcctcgaaggttcacggcaagggaaaccaccgatagcagtgtctagtagcaacctgtaaagccgcaatgcagcatcactggaaaatacaaaccaatggctaaaagtacataagttaatgcctaaagaagtcatataccagcggctaataattgtacaatcaagtggctaaacgtaccgtaatttgccaacggcttgtggggttgcagaagcaacggcaaagccccacttccccacgtttgtttcttcactcagtccaatctcagctggtgatcccccaattgggtcgcttgtttgttccggtgaagtgaaagaagacagaggtaagaatgtctgactcggagcgttttgcatacaaccaagggcagtgatggaagacagtgaaatgttgacattcaaggagtatttagccagggatgcttgagtgtatcgtgtaaggaggtttgtctgccgatacgacgaatactgtatagtcacttctgatgaagtggtccatattgaaatgtaagtcggcactgaacaggcaaaagattgagttgaaactgcctaagatctcgggccctcgggccttcggcctttgggtgtacatgtttgtgctccgggcaaatgcaaagtgtggtaggatcgaacacactgctgcctttaccaagcagctgagggtatgtgataggcaaatgttcaggggccactgcatggtttcgaatagaaagagaagcttagccaagaacaatagccgataaagatagcctcattaaacggaatgagctagtaggcaaagtcagcgaatgtgtatatataaaggttcgaggtccgtgcctccctcatgctctccccatctactcatcaactcagatcctccaggagacttgtacaccatcttttgaggcacagaaacccaatagtcaaccgcggactgcgcatcatgtatcggaagttggccgtcatctcggccttcttggccacacctcgtgctagactaggcgcgccgcgcgccagctccgtgcgaaagcctgacgcaccggtagattcttggtgagcccgtatcatgacggcggcgggagctacatggccccgggtgatttattttttttgtatctacttctgacccttttcaaatatacggtcaactcatctttcactggagatgcggcctgcttggtattgcgatgttgtcagcttggcaaattgtggctttcgaaaacacaaaacgattccttagtagccatgcattttaagataacggaatagaagaaagaggaaattaaaaaaaaaaaaaaaacaaacatcccgttcataacccgtagaatcgccgctcttcgtgtatcccagtaccagtttattttgaatagctcgcccgctggagagcatcctgaatgcaagtaacaaccgtagaggctgacacggcaggtgttgctagggagcgtcgtgttctacaaggccagacgtcttcgcggttgatatatatgtatgtttgactgcaggctgctcagcgacgacagtcaagttcgccctcgctgcttgtgcaataatcgcagtggggaagccacaccgtgactcccatctttcagtaaagctctgttggtgtttatcagcaatacacgtaatttaaactcgttagcatggggctgatagcttaattaccgtttaccagtgccatggttctgcagctttccttggcccgtaaaattcggcgaagccagccaatcaccagctaggcaccagctaaaccctataattagtctcttatcaacaccatccgctcccccgggatcaatgaggagaatgagggggatgcggggctaaagaagcctacataaccctcatgccaactcccagtttacactcgtcgagccaacatcctgactataagctaacacagaatgcctcaatcctgggaagaactggccgctgataagcgcgcccgcctcgcaaaaaccatccctgatgaatggaaagtccagacgctgcctgcggaagacagcgttattgatttcccaaagaaatcggggatcctttcagaggccgaactgaagatcacagaggcctccgctgcagatcttgtgtccaagctggcggccggagagttgacctcggtggaagttacgctagcattctgtaaacgggcagcaatcgcccagcagttagtagggtcccctctacctctcagggagatgtaacaacgccaccttatgggactatcaagctgacgctggcttctgtgcagacaaactgcgcccacgagttcttccctgacgccgctctcgcgcaggcaagggaactcgatgaatactacgcaaagcacaagagacccgttggtccactccatggcctccccatctctctcaaagaccagcttcgagtcaaggtacaccgttgcccctaagtcgttagatgtccctttttgtcagctaacatatgccaccagggctacgaaacatcaatgggctacatctcatggctaaacaagtacgacgaaggggactcggttctgacaaccatgctccgcaaagccggtgccgtcttctacgtcaagacctctgtcccgcagaccctgatggtctgcgagacagtcaacaacatcatcgggcgcaccgtcaacccacgcaacaagaactggtcgtgcggcggcagttctggtggtgagggtgcgatcgttgggattcgtggtggcgtcatcggtgtaggaacggatatcggtggctcgattcgagtgccggccgcgttcaacttcctgtacggtctaaggccgagtcatgggcggctgccgtatgcaaagatggcgaacagcatggagggtcaggagacggtgcacagcgttgtcgggccgattacgcactctgttgagggtgagtccttcgcctcttccttcttttcctgctctataccaggcctccactgtcctcctttcttgctttttatactatatacgagaccggcagtcactgatgaagtatgttagacctccgcctcttcaccaaatccgtcctcggtcaggagccatggaaatacgactccaaggtcatccccatgccctggcgccagtccgagtcggacattattgcctccaagatcaagaacggcgggctcaatatcggctactacaacttcgacggcaatgtccttccacaccctcctatcctgcgcggcgtggaaaccaccgtcgccgcactcgccaaagccggtcacaccgtgaccccgtggacgccatacaagcacgatttcggccacgatctcatctcccatatctacgcggctgacggcagcgccgacgtaatgcgcgatatcagtgcatccggcgagccggcgattccaaatatcaaagacctactgaacccgaacatcaaagctgttaacatgaacgagctctgggacacgcatctccagaagtggaattaccagatggagtaccttgagaaatggcgggaggctgaagaaaaggccgggaaggaactggacgccatcatcgcgccgattacgcctaccgctgcggtacggcatgaccagttccggtactatgggtatgcctctgtgatcaacctgctggatttcacgagcgtggttgttccggttacctttgcggataagaacatcgataagaagaatgagagtttcaaggcggttagtgagcttgatgccctcgtgcaggaagagtatgatccggaggcgtaccatggggcaccggttgcagtgcaggttatcggacggagactcagtgaagagaggacgttggcgattgcagaggaagtggggaagttgctgggaaatgtggtgactccatagctaataagtgtcagatagcaatttgcacaagaaatcaataccagcaactgtaaataagcgctgaagtgaccatgccatgctacgaaagagcagaaaaaaacctgccgtagaaccgaagagatatgacacgcttccatctctcaaaggaagaatcccttcagggttgcgtttccagtctagacacgtataacggcacaagtgtctctcaccaaatgggttatatctcaaatgtgatctaaggatggaaagcccagaatatcgatcgcgcgcagatccatatatagggcccgggttataattacctcaggtcgacgtcccatggccattcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaaattgtaaacgttaatattttgttaaaattcgcgttaaatttttgttaaatcagctcattttttaaccaataggccgaaatcggcaaaatcccttataaatcaaaagaatagcccgagatagggttgagtgttgttccagtttggaacaagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtactatggttgctttgacgtatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgc

SEQ ID NO: 60 - DNA, 4047 bp, Streptococcus oralis
atgatcgacggcaaaaactactacgtacaggatgatggcacggtaaagaagaatttcgcggtagaactgaatggtcgtatcctgtattttgatgcagaaaccggcgctctggttgatagcaacgagtatcagttccaacagggtacgagcagcctgaacaatgaattttctcagaagaacgcattctatggtacgaccgataaggatattgagactgtggatggctacctgaccgcagatagctggtatcgcccgaaattcatcctgaaggatggcaagacgtggaccgcgagcacggaaacggatctgcgtccgctgttgatggcatggtggccggacaagcgtacccaaatcaactatctgaactacatgaaccagcagggtctgggtgcgggtgcgtttgagaacaaagtggagcaggccctgctgacgggtgcaagccaacaggtacaacgcaagatcgaagagaagattggtaaagagggtgataccaagtggctgcgcaccctgatgggtgcgttcgtgaaaacgcaaccaaactggaatatcaaaaccgagtctgaaacgaccggcacgaaaaaggaccatctgcaaggcggtgcactgctgtatacgaacaacgagaaatccccgcacgcggacagcaaatttcgtctgctgaatcgtaccccgaccagccaaaccggcacgccgaagtatttcatcgacaagtctaacggtggctacgaatttctgctggcgaacgattttgacaatagcaatcctgcggtacaagctgagcagctgaattggctgcactacatgatgaactttggcagcattgttgcgaatgatccgaccgcgaatttcgacggcgttcgtgtggatgctgttgataacgtcaatgcggacttgttgcaaattgcaagcgattactttaagagccgttacaaagtcggtgagagcgaagaagaagcgatcaagcacctgtccatcctggaagcatggagcgataacgacccggactacaacaaagataccaagggtgcacagttggcgattgataacaaactgcgcctgagcctgctgtactctttcatgcgtaatctgagcatccgtagcggtgttgaaccgacgattaccaatagcctgaatgaccgttccagcgaaaagaagaacggcgagcgtatggcaaattacatcttcgtgcgtgcccacgatagcgaggtccaaacggtgatcgccgacatcattcgcgaaaacatcaatccgaacaccgacggcctgacgtttacgatggacgagctgaagcaggcattcaagatttacaacgaggacatgcgcaaggcggacaaaaagtatacccagtttaacattcctaccgcacacgcgctgatgctgtctaataaggattctattacccgcgtgtactatggtgatctgtatactgacgatggtcagtacatggagaagaaaagcccgtatcacgatgcgattgacgctctgctgcgtgcacgtattaaatacgtcgcgggtggccaggatatgaaagtgacctatatgggcgtgccgcgtgaagcggataagtggagctataacggcattctgaccagcgtgcgctatggcacgggcgctaacgaagccacggatgagggcactgcggaaacgcgcacgcaaggtatggcagtgattgcgagcaataatccaaatctgaaactgaatgaatgggacaagttgcaagtcaacatgggtgcggcgcataagaatcaatattaccgtccggttctgctgaccactaaggacggtatcagccgttatctgaccgatgaagaagtgcctcagagcctgtggaaaaagacggacgcaaacggtattctgaccttcgacatgaatgatattgctggctacagcaacgtgcaagttagcggttacctggccgtctgggtcccggtcggtgcgaaggcggatcaagatgcgcgcacgaccgcatccaagaagaaaaatgcgtcgggtcaggtgtacgaaagcagcgcggctctggatagccagctgatttacgaaggtttcagcaactttcaagactttgccactcgcgatgatcagtacacgaacaaggtcattgcgaaaaacgtgaatctgttcaaagaatggggtgtgaccagcttcgagctgccgccgcagtacgtgagcagccaagatggcacctttctggacagcattatccaaaacggctatgcatttgaagaccgttacgatatggcgatgagcaagaataacaagtatggtagcctgaaagacctgttgaacgcgctgcgcgcactgcacagcgtcaacattcaagcaatcgccgattgggtgccggaccaaatttacaacttgccgggcaaagaggtggtgaccgcaactcgtgtcaacaactacggcacctaccgtgagggtgctgaaatcaaagaaaagctgtatgtcgccaatagcaagaccaacgaaaccgatttccaaggtaaatacggtggtgcgttcctggatgagctgaaggcgaagtacccggagattttcgagcgtgtccaaatcagcaacggccaaaagatgactaccgatgaaaagatcaccaaatggagcgcgaaatactttaatggcaccaatattctgggtcgtggcgcgtactatgtcctgaaagattgggccagcaatgattacctgacgaaccgtaacggcgagattgttttgccgaagcaactggttaacaagaatagctataccggctttgtcagcgacgcgaacggcacgaagttctattctacctctggctaccaggcgaagaacagcttcattcaagacgaaaacggtaattggtattactttgacaaacgtggttatctggttacgggcgcacacgagattgatggcaagcatgtctacttcctgaaaaacggtatccaactgcgtgacagcatccgtgaggatgagaacggtaatcaatactattacgaccagaccggcgcacaagtgctgaaccgttactacacgacggacggtcagaattggcgctatttcgatgcgaaaggtgttatggcacgcggcctggtaaagattggtgacggccaacagtttttcgatgaaaacggttaccaggtcaagggcaagattgttagcgcaaaagacggcaagctgcgctactttgataaagactctggcaatgctgtcattaatcgtttcgcgcagggtgacaatccgagcgactggtactatttcggtgtggaatttgctaaactgacgggtttgcaaaagatcggccagcagacgctgtattttgaccaagacggtaagcaagtcaaaggtaagatcgtaactctgtcggacaaaagcattcgttacttcgatgccaacagcggtgaaatggcggttggcaagttcgcggaaggtgcaaagaatgagtggtattatttcgataaaaccggcaaagcggttactggtttgcagaaaattggtaagcagaccctgtactttgaccaggacggtaaacaggttaaaggcaaggttgtcacgctggctgataaaagcatccgctacttcgacgcagactccggcgagatggcggtcggtaagtttgcagagggtgcgaagaacgagtggtactattttgatcagactggcaaggccgtgactggtttgcaaaagattgacaagcaaaccttgtacttcgaccaggacggtaaacaagtcaagggtaagattgtgacgttgagcgacaagtcgatccgttactttgatgctaatagcggtgagatggctactaacaaattcgtcgagggctcgcagaatgaatggtactacttcgatcaagcgggtaaggctgttacgggcttgcaacaggtcggtcagcaaactctgtacttcacccaggatggtaagcaagtgaagggtaaggtcgtggacgtgaacggtgtttctcgttatttcgacgcaaactccggtgacatggctcgttctaaatggattcaactggaagatggcagctggatgtatttcgaccgtgacggtcgtggccagaattttggccgtaactaa

SEQ ID NO: 61 - protein, 1348 aa, Streptococcus oralis
MIDGKNYYVQDDGTVKKNFAVELNGRILYFDAETGALVDSNEYQFQQGTSSLNNEFSQKNAFYGTTDKDIETVDGYLTADSWYRPKFILKDGKTWTASTETDLRPLLMAWWPDKRTQINYLNYMNQQGLGAGAFENKVEQALLTGASQQVQRKIEEKIGKEGDTKWLRTLMGAFVKTQPNWNIKTESETTGTKKDHLQGGALLYTNNEKSPHADSKFRLLNRTPTSQTGTPKYFIDKSNGGYEFLLANDFDNSNPAVQAEQLNWLHYMMNFGSIVANDPTANFDGVRVDAVDNVNADLLQIASDYFKSRYKVGESEEEAIKHLSILEAWSDNDPDYNKDTKGAQLAIDNKLRLSLLYSFMRNLSIRSGVEPTITNSLNDRSSEKKNGERMANYIFVRAHDSEVQTVIADIIRENINPNTDGLTFTMDELKQAFKIYNEDMRKADKKYTQFNIPTAHALMLSNKDSITRVYYGDLYTDDGQYMEKKSPYHDAIDALLRARIKYVAGGQDMKVTYMGVPREADKWSYNGILTSVRYGTGANEATDEGTAETRTQGMAVIASNNPNLKLNEWDKLQVNMGAAHKNQYYRPVLLTTKDGISRYLTDEEVPQSLWKKTDANGILTFDMNDIAGYSNVQVSGYLAVWVPVGAKADQDARTTASKKKNASGQVYESSAALDSQLIYEGFSNFQDFATRDDQYTNKVIAKNVNLFKEWGVTSFELPPQYVSSQDGTFLDSIIQNGYAFEDRYDMAMSKNNKYGSLKDLLNALRALHSVNIQAIADWVPDQIYNLPGKEVVTATRVNNYGTYREGAEIKEKLYVANSKTNETDFQGKYGGAFLDELKAKYPEIFERVQISNGQKMTTDEKITKWSAKYFNGTNILGRGAYYVLKDWASNDYLTNRNGEIVLPKQLVNKNSYTGFVSDANGTKFYSTSGYQAKNSFIQDENGNWYYFDKRGYLVTGAHEIDGKHVYFLKNGIQLRDSIREDENGNQYYYDQTGAQVLNRYYTTDGQNWRYFDAKGVMARGLVKIGDGQQFFDENGYQVKGKIVSAKDGKLRYFDKDSGNAVINRFAQGDNPSDWYYFGVEFAKLTGLQKIGQQTLYFDQDGKQVKGKIVTLSDKSIRYFDANSGEMAVGKFAEGAKNEWYYFDKTGKAVTGLQKIGKQTLYFDQDGKQVKGKVVTLADKSIRYFDADSGEMAVGKFAEGAKNEWYYFDQTGKAVTGLQKIDKQTLYFDQDGKQVKGKIVTLSDKSIRYFDANSGEMATNKFVEGSQNEWYYFDQAGKAVTGLQQVGQQTLYFTQDGKQVKGKVVDVNGVSRYFDANSGDMARSKWIQLEDGSWMYFDRDGRGQNFGRN

SEQ ID NO: 62 - DNA, 3804 bp, Streptococcus mutans
atggtcaatggcaaatactactactacaaagaggacggtacgttgcagaagaactacgcactgaacattaacggcaagacctttttctttgacgagactggcgccctgagcaataacaccctgccgagcaagaaaggtaacatcaccaataacgacaataccaatagcttcgcgcaatacaatcaggtgtattcgacggatgcagcgaacttcgaacatgtcgatcactacctgacggcggagtcctggtatcgcccgaagtatattctgaaagatggcaagacgtggactcagtccacggagaaagattttcgcccgttgttgatgacctggtggccggatcaggaaacccagcgtcagtatgtaaactatatgaatgcccagctgggtattcaccagacctacaacacggcgaccagcccgttgcaactgaatctggcggcacagacgatccagaccaagattgaagagaagatcacggcggagaagaacactaattggctgcgtcaaacgatttcggcctttgtcaaaacccagagcgcgtggaactcggacagcgaaaaaccgtttgacgatcatctgcaaaagggtgcactgctgtactctaacaatagcaagttgacctctcaagctaatagcaactaccgtattctgaaccgtaccccaaccaaccaaaccggcaagaaagatccgcgttataccgctgaccgtaccatcggtggttatgagttcttgctggcgaacgatgtggataatagcaatcctgttgttcaagcggaacagctgaactggctgcacttcctgatgaactttggcaatatctatgcaaacgaccctgacgccaactttgacagcatccgtgtagacgccgtggacaacgtggatgcagatttgttgcaaatcgctggtgactatctgaaggctgcaaagggcatccataagaacgacaaagcagcgaacgaccacctgtcgatcctggaagcatggagctataatgacaccccgtatctgcacgacgacggtgacaacatgatcaatatggacaaccgtctgcgtctgagcctgctgtatagcctggcgaagccgttgaaccagcgttcgggcatgaacccgctgatcacgaacagcctggttaaccgtaccgatgacaacgcagaaaccgcagcggtcccgagctacagctttatccgtgcacacgatagcgaggttcaagacctgattcgtaacattattcgtgctgagattaatccgaacgtcgtcggttatagcttcacgatggaagagatcaagaaggcctttgagatttacaacaaggatctgctggcgacggaaaagaaatacacccactataacaccgcgctgagctacgcgctgctgctgaccaataagagcagcgttccgcgtgtgtattacggtgatatgtttactgacgacggtcagtacatggcacataaaacgatcaactacgaggctatcgaaacgctgttgaaggcgcgcattaagtacgtgtctggtggccaagcgatgcgtaatcaacaggtgggtaatagcgaaatcattacgagcgtccgctatggcaagggcgcactgaaagcgacggataccggcgatcgtaccacgcgcaccagcggcgttgcggttattgaaggcaataacccgagcctgcgcttgaaggcgagcgaccgcgtcgttgttaacatgggtgcagcacacaagaaccaggcatatcgtccgctgttgctgaccactgataatggcatcaaagcgtatcacagcgatcaggaagctgcgggcctggtgcgctataccaatgatcgtggtgaattgatcttcacggcagctgacattaaaggttatgcaaatccgcaagtcagcggttatctgggcgtctgggtgccggtcggcgcagcggctgatcaagacgtgcgtgtggccgcgagcaccgcgccatcgaccgacggtaaaagcgtgcaccagaatgcggcgctggacagccgtgtcatgtttgagggttttagcaactttcaagcctttgcaacgaagaaagaagagtacaccaacgtcgtcatcgcgaagaacgtcgataagttcgcggaatggggcgttaccgatttcgaaatggcaccgcagtatgtgtctagcaccgatggctcgtttctggattccgtgatccaaaatggttatgcatttaccgaccgctatgacctgggcattagcaagccgaataagtatggtacggcggatgatctggttaaagcgatcaaggcgctgcattctaaaggtattaaggttatggccgactgggttccagatcagatgtatgctttcccggaaaaagaagtggtgacggccacccgcgtggacaaatatggtacgccggtcgcgggcagccagatcaaaaacactctgtatgtcgtggatggcaaaagctccggtaaagatcagcaagcgaaatatggcggtgccttcctggaagagttgcaggcgaaatacccggaactgttcgcgcgtaagcagatcagcactggtgttccgatggacccgagcgtgaagattaaacaatggtccgcgaaatactttaacggcacgaacatcctgggtcgtggtgccggctacgtgctgaaagaccaggcaacgaatacgtactttagcttggtgtccgacaatacgtttctgccgaagtctctggtcaacccgaaccacggtacgagcagctctgtgaccggcctggtgttcgatggtaagggctacgtgtactactctaccagcggttaccaggccaagaatacgttcatcagcctgggtaacaactggtattacttcgacaataacggttacatggtcacgggtgcgcagagcatcaacggtgccaactactattttctgagcaacggcattcagctgcgtaatgcgatttacgacaatggcaataaggttctgagctactacggtaatgacggtcgtcgttatgagaatggctattacctgtttggccaacagtggcgctactttcaaaatggtattatggccgtcggtctgacccgtgtccacggtgcggtgcagtattttgacgccagcggcttccaagccaagggccagttcatcaccactgcggacggtaaactgcgttactttgaccgtgacagcggcaaccaaatcagcaatcgttttgttcgtaacagcaagggtgaatggtttttgttcgatcataacggcgtggcggttaccggcaccgttactttcaatggtcaacgtctgtactttaagccgaacggtgttcaggcaaagggtgagttcattcgcgacgcggatggtcacttgcgttactacgaccctaattccggtaatgaggttcgtaaccgtttcgtccgcaactctaagggcgaatggttcctgtttgaccacaatggcatcgcagtcaccggcgctcgtgtggtcaacggccaacgcttgtacttcaaaagcaatggcgtccaagctaagggtgagctgattaccgaacgtaagggccgtattaagtattatgatcctaacagcggtaacgaagtgcgtaaccgctacgtccgcaccagcagcggtaattggtactattttggtaacgatggttacgcgctgatcggctggcatgttgttgagggtcgtcgtgtgtactttgatgagaacggtgtctatcgttacgcgagccacgaccagcgtaatcattggaactacgactatcgtcgcgatttcggtcgtggtagcagctccgctatccgttttcgccatagccgtaacggctttttcgacaacttcttccgcttctaa

SEQ ID NO: 63 - protein, 1267 aa, Streptococcus mutans
MVNGKYYYYKEDGTLQKNYALNINGKTFFFDETGALSNNTLPSKKGNITNNDNTNSFAQYNQVYSTDAANFEHVDHYLTAESWYRPKYILKDGKTWTQSTEKDFRPLLMTWWPDQETQRQYVNYMNAQLGIHQTYNTATSPLQLNLAAQTIQTKIEEKITAEKNTNWLRQTISAFVKTQSAWNSDSEKPFDDHLQKGALLYSNNSKLTSQANSNYRILNRTPTNQTGKKDPRYTADRTIGGYEFLLANDVDNSNPVVQAEQLNWLHFLMNFGNIYANDPDANFDSIRVDAVDNVDADLLQIAGDYLKAAKGIHKNDKAANDHLSILEAWSYNDTPYLHDDGDNMINMDNRLRLSLLYSLAKPLNQRSGMNPLITNSLVNRTDDNAETAAVPSYSFIRAHDSEVQDLIRNIIRAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKATDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYAFPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFSLVSDNTFLPKSLVNPNHGTSSSVTGLVFDGKGYVYYSTSGYQAKNTFISLGNNWYYFDNNGYMVTGAQSINGANYYFLSNGIQLRNAIYDNGNKVLSYYGNDGRRYENGYYLFGQQWRYFQNGIMAVGLTRVHGAVQYFDASGFQAKGQFITTADGKLRYFDRDSGNQISNRFVRNSKGEWFLFDHNGVAVTGTVTFNGQRLYFKPNGVQAKGEFIRDADGHLRYYDPNSGNEVRNRFVRNSKGEWFLFDHNGIAVTGARVVNGQRLYFKSNGVQAKGELITERKGRIKYYDPNSGNEVRNRYVRTSSGNWYYFGNDGYALIGWHVVEGRRVYFDENGVYRYASHDQRNHWNYDYRRDFGRGSSSAIRFRHSRNGFFDNFFRF

SEQ ID NO: 64 - DNA, 3864 bp, Streptococcus mutans UA159
atgattgacggcaaatactactacatcggcagcgacggtcagccaaagaagaattttgcgttgacggttaacaataaagtcctgtattttgacaagaacacgggtgcgctgaccgacaccagccaatatcagttcaaacaaggtctgacgaagctgaacaacgactacacccctcacaatcagattgtcaactttgaaaatactagcctggaaactattgataactatgttactgccgactcttggtatcgtccgaaagacattctgaagaacggtaagacgtggaccgcgtcctctgagagcgatctgcgtccgctgctgatgtcctggtggcctgataagcagacccagatcgcatacctgaactacatgaaccaacaaggcttgggcactggcgagaactataccgctgatagctctcaagagagcctgaacctggcggcacaaaccgttcaagtcaaaatcgaaaccaagatcagccaaacgcaacagactcagtggctgcgtgacatcattaactctttcgttaagacgcaaccgaactggaatagccaaaccgagtctgacacgagcgctggtgaaaaagatcatttgcagggcggtgccctgctgtatagcaattcggacaaaaccgcatacgcaaatagcgactatcgtctgctgaaccgtaccccgaccagccagactggtaagccgaaatacttcgaggacaatagcagcggtggttacgacttcctgttggcaaacgatattgataattccaatccggtggtgcaggctgagcagctgaattggctgcattacctgatgaattacggtagcattgtcgcaaatgacccggaagcgaatttcgatggtgtccgtgttgacgcggtggataacgtgaacgcagacctgttgcagatcgcaagcgattatctgaaagcccattatggtgttgataagagcgagaagaatgcgatcaaccacctgagcatcctggaagcgtggtctgacaacgacccacagtataacaaagacaccaaaggtgcccagctgccgatcgacaacaaactgcgtctgtcgttgctgtacgcactgacccgtccgctggagaaggatgcaagcaacaaaaatgagattcgtagcggtctggagccggttattaccaattccctgaataatcgttccgctgagggcaagaactctgaacgcatggcgaattacatcttcatccgtgctcacgattctgaagttcaaacggtgatcgcaaagatcatcaaagcgcagattaacccgaaaacggatggcctgaccttcaccctggatgagctgaaacaggcgttcaaaatctataacgaggatatgcgccaggcgaagaagaagtatacccagagcaatatcccgacggcatacgccctgatgctgagcaataaggactccatcacgcgcctgtattacggtgatatgtacagcgatgatggccaatacatggcgaccaaatccccgtactacgatgcgattgacaccctgctgaaggcgcgcattaagtatgccgctggcggtcaggatatgaagatcacctacgttgagggtgacaaaagccacatggactgggactatacgggtgtcctgacgagcgttcgctacggcacgggcgcaaacgaagcgaccgaccagggcagcgaagctaccaagacgcaaggtatggccgtcatcacttctaacaacccgtccctgaagctgaatcagaacgacaaggtcattgtcaatatgggcaccgctcacaaaaatcaggaataccgtccgttgctgctgaccaccaaagacggtctgaccagctacaccagcgacgccgctgccaagagcctgtaccgtaaaacgaacgataagggcgagttggtgttcgatgcaagcgacattcagggctatctgaatccgcaagtgagcggttacctggctgtttgggtgcctgtgggtgcgagcgacaaccaggatgtgcgtgtcgcggccagcaataaagccaatgcgaccggccaagtctatgaaagcagcagcgcactggatagccaactgatttatgagggtttttccaactttcaggacttcgtcaccaaggattctgattacaccaataaaaagatcgcgcaaaatgtccagctgtttaagagctggggcgtcaccagctttgagatggctccgcaatacgtcagcagcgaggacggcagctttttggacagcattatccagaacggctatgcgttcgaggatcgttacgacctggcgatgagcaaaaacaacaaatacggctcccagcaggacatgatcaacgcggttaaggcgctgcataagagcggtatccaagtgatcgcggactgggtcccggatcaaatctacaatttgccgggtaaagaggtcgtcaccgcgacccgtgtgaacgactacggcgagtatcgcaaggactccgaaatcaaaaacaccctgtacgccgccaacaccaaaagcaacggtaaagattatcaagcaaagtacggtggcgcctttttgagcgagctggccgccaaatatccgagcatctttaaccgcactcagattagcaatggcaagaagatcgacccgtctgaaaagatcaccgcctggaaggccaaatacttcaatggtacgaacattttgggtcgcggcgttggttacgtcttgaaagacaatgccagcgacaagtattttgagctgaagggcaatcagacttatctgccgaagcaaatgacgaataaagaagcctcgactggtttcgttaatgacggcaatggtatgaccttttacagcacgagcggttatcaagcgaagaacagcttcgttcaggacgcaaaaggcaactggtactactttgacaacaatggccacatggtttacggtctgcaacatctgaacggcgaggtgcaatacttcctgagcaatggcgtgcaactgcgtgaatccttcttggaaaatgccgacggcagcaaaaactatttcggtcacctgggcaaccgttatagcaatggttactacagcttcgataatgatagcaaatggcgctatttcgatgcgagcggtgttatggcagtgggtctgaaaactattaacggtaacacccagtatttcgatcaagacggctaccaagtgaagggtgcatggattaccggcagcgatggtaagaagcgttacttcgacgacggtagcggcaatatggcagttaatcgctttgctaacgacaagaatggcgattggtattacctgaatagcgacggtattgcactggtgggtgttcagaccatcaacggcaaaacgtattactttggccaagatggtaaacaaatcaaaggcaaaatcattaccgataatggtaaactgaaatactttctggcgaacagcggtgagctggcgcgtaacatttttgcgaccgacagccagaacaactggtattacttcggctcggatggtgttgcggttacgggttcgcagacgattgcgggtaaaaagttgtactttgcgtccgacggtaaacaggtgaagggtagctttgttacttacaatggtaaagtgcactattaccatgcggacagcggcgaactgcaagtcaaccgtttcgaggcggataaagacggtaattggtactatctggacagcaacggtgaggcactgacgggtagccagcgtatcaatggtcaacgtgtgtttttcacccgcgagggcaaacaggttaagggtgatgtcgcgtatgatgaacgcggcttgctgcgctattacgacaaaaacagcggtaatatggtgtacaacaaggtggtcacgctggcgaacggtcgtcgtattggtattgaccgctggggtattgctcgctattactaa

SEQ ID NO: 65 - protein, 1287 aa, Streptococcus mutans UA159
MIDGKYYYIGSDGQPKKNFALTVNNKVLYFDKNTGALTDTSQYQFKQGLTKLNNDYTPHNQIVNFENTSLETIDNYVTADSWYRPKDILKNGKTWTASSESDLRPLLMSWWPDKQTQIAYLNYMNQQGLGTGENYTADSSQESLNLAAQTVQVKIETKISQTQQTQWLRDIINSFVKTQPNWNSQTESDTSAGEKDHLQGGALLYSNSDKTAYANSDYRLLNRTPTSQTGKPKYFEDNSSGGYDFLLANDIDNSNPVVQAEQLNWLHYLMNYGSIVANDPEANFDGVRVDAVDNVNADLLQIASDYLKAHYGVDKSEKNAINHLSILEAWSDNDPQYNKDTKGAQLPIDNKLRLSLLYALTRPLEKDASNKNEIRSGLEPVITNSLNNRSAEGKNSERMANYIFIRAHDSEVQTVIAKIIKAQINPKTDGLTFTLDELKQAFKIYNEDMRQAKKKYTQSNIPTAYALMLSNKDSITRLYYGDMYSDDGQYMATKSPYYDAIDTLLKARIKYAAGGQDMKITYVEGDKSHMDWDYTGVLTSVRYGTGANEATDQGSEATKTQGMAVITSNNPSLKLNQNDKVIVNMGTAHKNQEYRPLLLTTKDGLTSYTSDAAAKSLYRKTNDKGELVFDASDIQGYLNPQVSGYLAVWVPVGASDNQDVRVAASNKANATGQVYESSSALDSQLIYEGFSNFQDFVTKDSDYTNKKIAQNVQLFKSWGVTSFEMAPQYVSSEDGSFLDSIIQNGYAFEDRYDLAMSKNNKYGSQQDMINAVKALHKSGIQVIADWVPDQIYNLPGKEVVTATRVNDYGEYRKDSEIKNTLYAANTKSNGKDYQAKYGGAFLSELAAKYPSIFNRTQISNGKKIDPSEKITAWKAKYFNGTNILGRGVGYVLKDNASDKYFELKGNQTYLPKQMTNKEASTGFVNDGNGMTFYSTSGYQAKNSFVQDAKGNWYYFDNNGHMVYGLQHLNGEVQYFLSNGVQLRESFLENADGSKNYFGHLGNRYSNGYYSFDNDSKWRYFDASGVMAVGLKTINGNTQYFDQDGYQVKGAWITGSDGKKRYFDDGSGNMAVNRFANDKNGDWYYLNSDGIALVGVQTINGKTYYFGQDGKQIKGKIITDNGKLKYFLANSGELARNIFATDSQNNWYYFGSDGVAVTGSQTIAGKKLYFASDGKQVKGSFVTYNGKVHYYHADSGELQVNRFEADKDGNWYYLDSNGEALTGSQRINGQRVFFTREGKQVKGDVAYDERGLLRYYDKNSGNMVYNKVVTLANGRRIGIDRWGIARYY

SEQ ID NO: 66 - DNA, 4068 bp, Streptococcus gallolyticus ATCC BAA-2069
atgatcgacggcaaatactactatattgacgaggacggtaacgtaaagaagaatttcgcgattacggtggatggtcagttgctgtacttcgacgctgaaacgggtgctctgaccagcacgtccacctatagcttctccgagggcctgactaatctggtcgataacttcagcattaacaaccagtcctacgacagcaccgaagagtcgtttgagctgatcgacggttacctgaccgtcaatacttggtaccgtccgaccaaaattctggaaaacggtgaaacctgggtcgatagcaccgaaacggatttccgtccgctgctgatggcctggtggccggatgttgacacccaaattgactacttgaactacatgagcgattacttcgatctgggtacgacctatagcgctgacgattcccaagcgagcctgaatctggcagctgaggcggttcaggtgaaaattgaacaagaaattacccgtcaagagaacaccgcctggctgcgcgagatcatctctagctttgttaccacccaggataaatggaatatcaataccgagaatgagggcaccgaccatctgcaaggtggtgccctgctgtacgttaacagcgacttgactccgtgggcaaacagcgattatcgcctgctgaaccgcaccccgacgtaccagacgggtgagactaattactttaaagcagatcgtactggtggctacgaatttctgctggcaaatgacgtggataattctaacccggtcgttcaagccgaacagttgaaccagctgtactacttgatgaattggggctctattgtattcggtgatgacgacgccaattttgatggcgtgcgtgttgacgcggtggacaatgtgaacgctgacctgttgcagatttacacgaacctgttcgaagcggcgtatggtgttaacgagtctgaggcgcaggccctggctcacattagcatcctggaagcgtggtcttataacgacccggactacaaccacgacacgaatggcgctgccctggcaatcgacaatggtctgcgtctgagctttctgtactctttgacgcgccctacggacgagcgcagcggtttggagccactgatcacctctgagattggcctgaccgatcgttccgaggactctgcatacggtgacaccatgccgagctatgttttcgtccgtgcacatgacagcgaggttcagaccattattgcgagcattatcgcagaacagatcaacccggaaaccgatggctataccttcaccctggacgagctgaaccaggcgtttgagatttacaacgcggatatgaacagcgtggataaagagtatacgcattacaatatcccggctgcgtatagcctgctgctgaccaacatggaaagcgtcccgcgtgtttactacggtgacctgtatacggataacggtcagtacatggcgactaagagcccgtattatgaccagatcaccaccctgctgcaagcgcgcattcgttacgcggcgggtggccaatctatggctgttacgtactacacccctgcgtcgagcatgtctaccgacaatgcggatagcgtcctgaatgagactggtgtgctgacttctgtgcgttacggctatggcatcatgaccgccgaccaagaggccacggacgactccgttctgacctctggtattgttactattatcagcaacaaccctaatttgcagctggatgattccgaagtgattgcagtccaggttggtgtggcgcacgctggtcagtattatcgtccgctgttgtacccgacggcggatggtctgcaaagctacctgaacgatagcgataccgacattactaagctggtcgatgataatggttatatctactttacggcagatgagattaaaggctacgaaacggttgacatgaatggctacctgagcgtttgggtcccggttggtgcagacgagaatcaggacatccgtgtcagcgcagacaccagcgcgtacaccgagggtgaattgatctatcaagcaaccgcagcgctggatagccaagtgatctacgagggtttcagcaacttccaagatttcgttacctctaacagcgagtacactaacaagctgatcgcggagaacgtcgatctgtttaccagctggggcattacgagctttgagatggcgccacagtatgtgagcaccgatgacggtacttttctggatagcatcattcaaaacggttatgcatttgacgatcgctacgacctggcaatgagccagaataacaagtatggtagcgctgaagatttgcgtaatgccatcaaggccctgcacgctgctggcattcaggtcattgctgactgggtgccggatcaaatctattcgctgccaggcgaagaagtcgttacggcgactcgcgtgaatgactatggcgaagaaaccgaaggcgcgtacattaacaatacgttgtatgtggcgaacagcaaaagcagcggcgaggactaccaggcacagtatggtggtgagttcctggattacttgcaagaaacctacccggaaatgttcgaagttgcgatgattagcacgggtgagccgattgatccgagcaccaagatcaagatttggaaagcagaatactttaatggtacgaacattctgggtaagggcgctggttacgtgctgagcgatgccgcgactggcacgtactttaccgtgactgagaatggcacgtttctgccgaagcagctgaccaccgactccgccattacgggtttctattacgacggtacgggtatgtcttactttagcacctcgggttatcgcgctaaagcgagcttcattgtttacaacggctactactactattttgatgataacggctacatggtcactggcacggtggaaatcaacggtaagacctactatttcctgccgaatggtattcagctgcgtgatgcgatttacgaagacgagaacggtaatcagtactatttcggtccgttgggcaaccagtatttcaacaactattacagctttgacgttgaagaggtggtggacggtgtaacgactacggtaacgaagtggcgtcattttgacgagaacggcgtgatggcgcgtggtttggtcgagattgatggtgtctaccagtattacgatgaaaacggctaccaggtcaaaggtgagctgatcaccgatgctgatggtaatttgcgttatttcaaagaagatagcggtgaaatggttgttagcgattttgtgaagatcggcgataacaactggtactactttgacgaaaacggtattgcagtcacgggtgcccaaaccattgccggccagaacttgtatttcgatgacaacggtgtgcaggcgaaaggtgcctttgtcacgaacgccgatggcacgcgcagctattatgacgcggacagcggtgagaagatcgtggcagatttcttcactacgggcgataatgactggtattatgcagatgaaaatggcaatctggtgactggtagccaaactatcaatggtcaaaacctgtactttgctgaggacggtttgcaggccaagggtgtgtttgttaccgatacggctggtaacattcactattatgatgcgaactctggcgagttggcggttaataccttcgttggtgatggcgacgactggtattactttgatgagaatggcatcgcagttaccggcgcacaagtcattaacggtcaacacctgtatttcgcagacaacggcatccaagtgaaaggtgaaatcgtcaccgacgcaaacggcaaccgctattactacgatgcagattccggcgaaatggcagttaacacctttgtggagattgacggtgtttggtactattttggtgccgatggtatcgcggtgacgggtgcacaagtaattgatggtcagaatttgtactttaacgcagacggtagccaagtcaagggtgacgttgtccgtatcaacggtttgcgttactactacgacgctaatagcggcgaacaggtgcgcaatcagtgggtcacgctgccggatggtactgttgttttctttaatgcgcgtggctatacttggggctaa

SEQ ID NO: 67 - protein, 1355 aa, Streptococcus gallolyticus ATCC BAA-2069
MIDGKYYYIDEDGNVKKNFAITVDGQLLYFDAETGALTSTSTYSFSEGLTNLVDNFSINNQSYDSTEESFELIDGYLTVNTWYRPTKILENGETWVDSTETDFRPLLMAWWPDVDTQIDYLNYMSDYFDLGTTYSADDSQASLNLAAEAVQVKIEQEITRQENTAWLREIISSFVTTQDKWNINTENEGTDHLQGGALLYVNSDLTPWANSDYRLLNRTPTYQTGETNYFKADRTGGYEFLLANDVDNSNPVVQAEQLNQLYYLMNWGSIVFGDDDANFDGVRVDAVDNVNADLLQIYTNLFEAAYGVNESEAQALAHISILEAWSYNDPDYNHDTNGAALAIDNGLRLSFLYSLTRPTDERSGLEPLITSEIGLTDRSEDSAYGDTMPSYVFVRAHDSEVQTIIASIIAEQINPETDGYTFTLDELNQAFEIYNADMNSVDKEYTHYNIPAAYSLLLTNMESVPRVYYGDLYTDNGQYMATKSPYYDQITTLLQARIRYAAGGQSMAVTYYTPASSMSTDNADSVLNETGVLTSVRYGYGIMTADQEATDDSVLTSGIVTIISNNPNLQLDDSEVIAVQVGVAHAGQYYRPLLYPTADGLQSYLNDSDTDITKLVDDNGYIYFTADEIKGYETVDMNGYLSVWVPVGADENQDIRVSADTSAYTEGELIYQATAALDSQVIYEGFSNFQDFVTSNSEYTNKLIAENVDLFTSWGITSFEMAPQYVSTDDGTFLDSIIQNGYAFDDRYDLAMSQNNKYGSAEDLRNAIKALHAAGIQVIADWVPDQIYSLPGEEVVTATRVNDYGEETEGAYINNTLYVANSKSSGEDYQAQYGGEFLDYLQETYPEMFEVAMISTGEPIDPSTKIKIWKAEYFNGTNILGKGAGYVLSDAATGTYFTVTENGTFLPKQLTTDSAITGFYYDGTGMSYFSTSGYRAKASFIVYNGYYYYFDDNGYMVTGTVEINGKTYYFLPNGIQLRDAIYEDENGNQYYFGPLGNQYFNNYYSFDVEEVVDGVTTTVTKWRHFDENGVMARGLVEIDGVYQYYDENGYQVKGELITDADGNLRYFKEDSGEMVVSDFVKIGDNNWYYFDENGIAVTGAQTIAGQNLYFDDNGVQAKGAFVTNADGTRSYYDADSGEKIVADFFTTGDNDWYYADENGNLVTGSQTINGQNLYFAEDGLQAKGVFVTDTAGNIHYYDANSGELAVNTFVGDGDDWYYFDENGIAVTGAQVINGQHLYFADNGIQVKGEIVTDANGNRYYYDADSGEMAVNTFVEIDGVWYYFGADGIAVTGAQVIDGQNLYFNADGSQVKGDVVRINGLRYYYDANSGEQVRNQWVTLPDGTVVFFNARGYTWG

SEQ ID NO: 68 - protein, 1772 aa, Lactococcus reuteri
MEIKKHFKLYKSGKQWVTAAVATVAVSTALLYGGVAHADQQVQSSTTQEQTSTVNADTTKTVNLDTNTDQPAQTTDKNQVANDTTTNQSKTDSTSTTVKNPTFIPVSTLSSSDNEKQSQNYNKPDNGNYGNVDAAYFNNNQLHISGWHATNASQGTDSRQVIVRDITTKTELGRTNVTNNVLRPDVKNVHNVYNADNSGFDVNINIDFSKMKDYRDSIEIVSRYSGNGKSVDWWSQPITFDKNNYAYLDTFEVKNGELHATGWNATNKAINYNHHFVILFDRTNGKEVTRQEVRDGQSRPDVAKVYPQVVGANNSGFDVTFNIGDLDYTHQYQILSRYSNADNGEGDYVTYWFAPQSIAPANQSNQGYLDSFDISKNGEVTVTGWNATDLSELQTNHYVILFDQTAGQQVASAKVDLISRPDVAKAYPTVKTAETSGFKVTFKVSNLQPGHQYSVVSRFSADENGNGNDKRHTDYWYSPVTLNQTASNIDTITMTSNGLHITGWMASDNSINEATPYAIILNNGREVTRQKLTLIARPDVAAVYPSLYNSAVSGFDTTIKLTNAQYQALNGQLQVLLRFSKAVDGNPNGTNTVTDQFSKNYATTGGNFDYVKVNGNQIEFSGWHATNQSNDKNSQWIIVLVNGKEVKRQLVNDTKDGAAGFNRNDVYKVNPAIENSIMSGFQGIITLPVTVKDENVQLVHRFSNDAKTGEGNYVDFWSEVMSVKDSFQKGNGPLNQFGLQTINGQQYYIDPTTGQPRKNFLLQNGNDWIYFDKDTGAGTNALKLQFDKGTISADEQYRRGNEAYSYDDKSIENVNGYLTADTWYRPKQILKDGTTWTDSKETDMRPILMVWWPNTVTQAYYLNYMKQYGNLLPASLPSFSTDADSAELNHYSELVQQNIEKRISETGSTDWLRTLMHEFVTKNSMWNKDSENVDYGGLQLQGGFLKYVNSDLTKYANSDWRLMNRTATNIDGKNYGGAEFLLANDIDNSNPVVQAEELNWLYYLMNFGTITGNNPEANFDGIRVDAVDNVDVDLLSIARDYFNAAYNMEQSDASANKHINILEDWGWDDPAYVNKIGNPQLTMDDRLRNAIMDTLSGAPDKNQALNKLITQSLVNRANDNTENAVIPSYNFVRAHDSNAQDQIRQAIQAATGKPYGEFNLDDEKKGMEAYINDQNSTNKKWNLYNMPSAYTILLTNKDSVPRVYYGDLYQDGGQYMEHKTRYFDTITNLLKTRVKYVAGGQTMSVDKNGILTNVRFGKGAMNATDTGTDETRTEGIGVVISNNTNLKLNDGESVVLHMGAAHKNQKYRAVILTTEDGVKNYTNDTDAPVAYTDANGDLHFTNTNLDGQQYTAVRGYANPDVTGYLAVWVPAGAADDQDARTAPSDEAHTTKTAYRSNAALDSNVIYEGFSNFIYWPTTESERTNVRIAQNADLFKSWGITTFELAPQYNSSKDGTFLDSIIDNGYAFTDRYDLGMSTPNKYGSDEDLRNALQALHKAGLQAIADWVPDQIYNLPGKEAVTVTRSDDHGTTWEVSPIKNVVYITNTIGGGEYQKKYGGEFLDTLQKEYPQLFSQVYPVTQTTIDPSVKIKEWSAKYFNGTNILHRGAGYVLRSNDGKYYNLGTSTQQFLPSQLSVQDNEGYGFVKEGNNYHYYDENKQMVKDAFIQDSVGNWYYFDKNGNMVANQSPVEISSNGASGTYLFLNNGTSFRSGLVKTDAGTYYYDGDGRMVRNQTVSDGAMTYVLDENGKLVSESFDSSATEAHPLKPGDLNGQK

SEQ ID NO: 69 - DNA, 5208 bp, Lactobacillus reuteri
atggatcagcaagtacaaagcagcaccacccaggagcagacgagcacggttaacgcggacacgactaaaaccgtcaatctggataccaacactgaccagccggctcagacgaccgataagaatcaggtcgcgaatgataccaccaccaaccaaagcaagacggacagcaccagcacgacggttaagaatccgacgtttattcctgttagcactttgtccagctccgataacgaaaagcagagccagaattacaataaaccagataacggtaattacggtaatgttgatgcggcctacttcaataacaatcagctgcacattagcggttggcacgcaaccaacgcgagccagggtacggatagccgccaagtaatcgtacgcgacattaccaccaagaccgagctgggtcgtactaatgtgaccaacaatgttctgcgtccggacgtgaaaaatgttcacaacgtctacaacgctgacaacagcggctttgatgtgaatatcaatattgatttcagcaagatgaaagactatcgtgacagcatcgagatcgtttctcgttatagcggcaacggcaagagcgttgactggtggtcgcagccgatcacgtttgacaaaaacaattatgcttatctggacactttcgaggtgaagaacggtgaactgcatgcaacgggctggaatgccaccaacaaggctatcaattacaatcaccacttcgttattctgtttgatcgtacgaatggcaaagaagtcacccgccaagaggtgcgtgatggtcaaagccgtccggatgtggcgaaggtatacccgcaagtcgttggcgcgaacaatagcggttttgacgttacgtttaacattggtgatttggactacacccatcagtaccagatcctgtctcgttacagcaacgcagacaacggtgaaggcgattatgtgacctattggtttgcgccgcagagcatcgctccggcgaatcaaagcaaccaaggttacctggacagcttcgatatttcgaaaaacggtgaggtgaccgtgacgggttggaatgcgacggatctgagcgagttgcaaacgaatcactacgtgatcctgtttgatcagacggcgggtcaacaggttgcatccgctaaggtcgacctgatcagccgtccagacgtcgcgaaggcgtaccctaccgttaaaacggcagaaacctccggtttcaaggtcacgtttaaggttagcaatctgcaaccgggccaccaatacagcgtcgttagccgctttagcgccgatgaaaacggtaatggcaacgacaaacgccacacggactactggtactctccggttaccctgaaccaaacggctagcaacattgacactatcaccatgacttccaacggtctgcacatcaccggctggatggcgagcgataatagcattaacgaagcgaccccgtacgcgattatcctgaacaacggtcgcgaggtgacgcgccagaaactgaccctgatcgcgcgtccggatgttgcggcagtgtatccgagcctgtacaatagcgcggttagcggcttcgacaccaccatcaagctgactaacgcgcaatatcaagcattgaacggccagctgcaagtgctgctgcgctttagcaaggcggtggacggtaacccgaatggtaccaataccgtcacggatcaatttagcaaaaactacgcaacgaccggtggtaatttcgattacgtcaaggttaatggtaaccaaattgagttttctggctggcacgcgacgaatcagagcaatgataagaacagccaatggattatcgtcttggttaacggtaaagaggtcaaacgccagctggtcaatgacacgaaagacggcgcagccggcttcaatcgtaatgatgtgtataaagtgaacccagcgatcgaaaatagcattatgtctggcttccagggcattatcacgttgccggttacggtgaaagacgaaaacgtgcagctggtgcaccgcttctccaatgacgcaaaaacgggtgagggcaattatgtcgatttctggagcgaggtgatgtctgtgaaggactctttccaaaagggtaatggtccgctgaaccagtttggcctgcaaaccatcaacggccaacaatactatattgacccgacgaccggccagccgcgtaagaatttcctgctgcaaaacggcaacgattggatttacttcgacaaagacactggcgcaggcaccaacgcgctgaaattgcagtttgataagggcacgattagcgctgacgaacaataccgtcgcggcaacgaggcgtactcctacgatgataagagcattgaaaatgtcaacggttacttgacggcggacacgtggtaccgcccgaagcagatcctgaaggatggcaccacttggaccgattccaaagaaaccgatatgcgtccgatcttgatggtctggtggccaaacacggtgactcaggcgtactatctgaactacatgaaacaatatggcaatctgctgccggcgagcctgccgagctttagcaccgacgccgatagcgcggagttgaatcattattccgagctggtccaacagaatatcgagaaacgtattagcgagactggtagcactgattggctgcgtaccctgatgcacgagttcgtgacgaagaatagcatgtggaacaaagatagcgagaacgttgactacggtggcctgcaactgcaaggtggtttcctgaagtacgttaacagcgacctgacgaagtacgcaaactctgattggcgtctgatgaaccgtaccgcgacgaacattgacggtaagaattacggtggtgccgagtttctgctggcgaatgacatcgacaactctaacccggtggtgcaggccgaagaattgaattggctgtattatctgatgaacttcggtaccatcaccggtaacaacccagaagctaacttcgacggcatccgtgtcgacgcggtcgataatgtggatgttgatctgctgagcattgcccgtgactactttaatgcagcgtataacatggaacaaagcgatgctagcgcgaataagcacatcaatattctggaagattggggctgggacgatccggcgtacgtgaacaaaatcggcaatccacagttgaccatggatgaccgcctgcgtaatgcaattatggacaccctgagcggtgcgccggataagaaccaagcgctgaacaagctgattactcagtctctggtgaatcgcgcaaatgataatactgaaaacgcggtgatcccttcctacaactttgtccgcgctcatgacagcaatgcccaggaccagatccgtcaagcgatccaggcggcaaccggcaaaccttatggcgagttcaacttggatgatgagaaaaagggtatggaggcttacatcaatgaccaaaatagcaccaataagaaatggaacctgtacaacatgccgagcgcatataccatcctgctgacgaataaggactcggtcccgcgtgtctactatggcgacttgtaccaggatggtggccagtacatggaacacaaaactcgttactttgacaccatcacgaatctgctgaaaacccgcgtcaagtatgtcgcaggcggccagaccatgtctgtggataagaatggcattttgactaatgtccgtttcggtaagggtgcgatgaacgcaactgacacgggtaccgatgaaacccgcaccgaaggtatcggcgttgttatcagcaacaatacgaatttgaaactgaatgacggcgaaagcgttgtgctgcacatgggcgctgcccataagaatcagaagtatcgtgcagtgatcctgaccacggaggacggtgtgaagaattacaccaacgacaccgatgcgccggtcgcatacaccgacgcgaacggcgatttgcatttcaccaatactaacctggacggtcagcaatataccgccgttcgtggctacgcaaacccggacgttacgggttatctggccgtctgggttcctgctggtgccgccgatgaccaagacgcacgtaccgctccgagcgacgaggcccacaccacgaaaacggcgtatcgttccaatgcggcattggactccaacgtcatctacgaaggcttttcgaactttatctattggccgacgaccgagagcgagcgcacgaatgtccgcatcgcgcagaacgcggatctgttcaaatcgtggggtatcaccaccttcgagctggcgccacagtacaatagcagcaaggacggtacgtttctggattcgatcattgacaatggttacgcgtttaccgatcgttatgacctgggtatgtctaccccgaacaagtacggtagcgatgaggatctgcgtaacgccctgcaagcactgcacaaggccggtctgcaagccatcgcagattgggttccggaccaaatctacaatctgccgggcaaagaggctgtcacggttactcgtagcgatgaccacggcactacctgggaggttagcccgatcaagaatgtggtgtatatcactaataccatcggtggtggcgaataccagaaaaagtatggtggtgaatttctggacaccttgcaaaaagaatatccgcagctgtttagccaagtttacccggtgacccaaacgacgattgaccctagcgttaagattaaagagtggtccgcgaagtacttcaatggtactaatatcctgcatcgcggtgcgggttacgtcctgcgtagcaatgatggtaagtattacaacctgggtactagcacccagcagttcctgccgagccagctgagcgttcaagataatgagggttacggtttcgttaaagagggtaacaactatcactattatgacgagaacaaacaaatggttaaggacgcgtttatccaggatagcgtcggcaattggtactattttgataagaacggcaatatggttgcaaaccaaagcccggttgaaatcagcagcaacggtgcgagcggcacctacttgtttttgaataatggtaccagcttccgcagcggcctggtcaaaacggatgcaggcacctattactacgatggtgacggtcgcatggttcgtaatcaaacggtttctgacggtgccatgacgtacgttctggacgaaaatggtaaactggtcagcgaatcttttgatagcagcgcgaccgaggcccatccgctgaaaccgggcgatctgaacggtcaaaagtaa

SEQ ID NO: 70 - protein, 1735 aa, Lactobacillus reuteri
MDQQVQSSTTQEQTSTVNADTTKTVNLDTNTDQPAQTTDKNQVANDTTTNQSKTDSTSTTVKNPTFIPVSTLSSSDNEKQSQNYNKPDNGNYGNVDAAYFNNNQLHISGWHATNASQGTDSRQVIVRDITTKTELGRTNVTNNVLRPDVKNVHNVYNADNSGFDVNINIDFSKMKDYRDSIEIVSRYSGNGKSVDWWSQPITFDKNNYAYLDTFEVKNGELHATGWNATNKAINYNHHFVILFDRTNGKEVTRQEVRDGQSRPDVAKVYPQVVGANNSGFDVTFNIGDLDYTHQYQILSRYSNADNGEGDYVTYWFAPQSIAPANQSNQGYLDSFDISKNGEVTVTGWNATDLSELQTNHYVILFDQTAGQQVASAKVDLISRPDVAKAYPTVKTAETSGFKVTFKVSNLQPGHQYSVVSRFSADENGNGNDKRHTDYWYSPVTLNQTASNIDTITMTSNGLHITGWMASDNSINEATPYAIILNNGREVTRQKLTLIARPDVAAVYPSLYNSAVSGFDTTIKLTNAQYQALNGQLQVLLRFSKAVDGNPNGTNTVTDQFSKNYATTGGNFDYVKVNGNQIEFSGWHATNQSNDKNSQWIIVLVNGKEVKRQLVNDTKDGAAGFNRNDVYKVNPAIENSIMSGFQGIITLPVTVKDENVQLVHRFSNDAKTGEGNYVDFWSEVMSVKDSFQKGNGPLNQFGLQTINGQQYYIDPTTGQPRKNFLLQNGNDWIYFDKDTGAGTNALKLQFDKGTISADEQYRRGNEAYSYDDKSIENVNGYLTADTWYRPKQILKDGTTWTDSKETDMRPILMVWWPNTVTQAYYLNYMKQYGNLLPASLPSFSTDADSAELNHYSELVQQNIEKRISETGSTDWLRTLMHEFVTKNSMWNKDSENVDYGGLQLQGGFLKYVNSDLTKYANSDWRLMNRTATNIDGKNYGGAEFLLANDIDNSNPVVQAEELNWLYYLMNFGTITGNNPEANFDGIRVDAVDNVDVDLLSIARDYFNAAYNMEQSDASANKHINILEDWGWDDPAYVNKIGNPQLTMDDRLRNAIMDTLSGAPDKNQALNKLITQSLVNRANDNTENAVIPSYNFVRAHDSNAQDQIRQAIQAATGKPYGEFNLDDEKKGMEAYINDQNSTNKKWNLYNMPSAYTILLTNKDSVPRVYYGDLYQDGGQYMEHKTRYFDTITNLLKTRVKYVAGGQTMSVDKNGILTNVRFGKGAMNATDTGTDETRTEGIGVVISNNTNLKLNDGESVVLHMGAAHKNQKYRAVILTTEDGVKNYTNDTDAPVAYTDANGDLHFTNTNLDGQQYTAVRGYANPDVTGYLAVWVPAGAADDQDARTAPSDEAHTTKTAYRSNAALDSNVIYEGFSNFIYWPTTESERTNVRIAQNADLFKSWGITTFELAPQYNSSKDGTFLDSIIDNGYAFTDRYDLGMSTPNKYGSDEDLRNALQALHKAGLQAIADWVPDQIYNLPGKEAVTVTRSDDHGTTWEVSPIKNVVYITNTIGGGEYQKKYGGEFLDTLQKEYPQLFSQVYPVTQTTIDPSVKIKEWSAKYFNGTNILHRGAGYVLRSNDGKYYNLGTSTQQFLPSQLSVQDNEGYGFVKEGNNYHYYDENKQMVKDAFIQDSVGNWYYFDKNGNMVANQSPVEISSNGASGTYLFLNNGTSFRSGLVKTDAGTYYYDGDGRMVRNQTVSDGAMTYVLDENGKLVSESFDSSATEAHPLKPGDLNGQK

SEQ ID NO: 71 - protein, 1365 aa, Streptococcus downei
MEKNLRYKLHKVKKQWVAIGVTTVTLSFLAGGQVVAADTNNNDGTSVQVNKMVPSDPKFDAQAQNGQLAQAMFKAANQADQTATSQVSPATDGRVDNQVTPAANQPAANVANQDVANPATDAGALNRQSAADTSTDGKAVPQTSDQPGHLETVDGKTYYVDANGQRLKNYSMVIDGKTYYFDGQTGEAQTDLPKTGQANQDNVPDSYQANNQAYSNEASSFETVDNYLTADSWYRPRKILKNGQSWQASSEGDLRPILMTWWPDAATKAAYANFWAKEGLISGSYRQNSANLDAATQNIQSAIEKKIASEGNTNWLRDKMSQFVKSQNQWSIASENETVYPNQDHMQGGALLFSNSKDTEHANSDWRLLNRNPTFQTGKQKYFTTNYAGYELLLANDVDNSNPVVQAEQLNHLHYLMNWGDIVMGDKDANFDGVRVDAVDNVNADLLQIQRDYYKAKYGTDQNEKNAIDHLSILEAWSGNDNDYVKDQNNFSLSIDNDQRSGMLKAFGYASAYRGNLSNLATAGLKNRSANPDSDPVPNYVFIRAHDSEVQTRIAKIIREKLGKTNADGLTNLTLDDLNKAFDIYNQDMNATDKVYYPNNLPMAYAWMLQNKDTVTRVYYGDMYTDNGQYMATKTPFYNAIETLLKGRIKYVAGGQAVSYKQDWSSGILTSVRYGKGANSASDAGNTETRNSGMALLINNRPNFRAYRNLTLNMGAAHKSQAYRPLLLSTKDGIATYLNDSDVDSRQYKYTDSQGNLSFSASELQSVANAQVSGMIQVWVPVGAADNQDVRTSPSTQATKDGNIYHQSDALDSQVIYEGFSNFQAFAQSPDQYTNAVIAKNGDLFKSWGITQFEMAPQYVSSEDGTFLDSVILNGYAFSDRYDLAMSKNNKYGSKQDLANAIKGLQSAGIKVLSDLVPNQLYNLPGKEVVTATRVNQYGQAKSGATINKTPYVANTRSYGDYQEQYGGKFLDDLQKLYPRLFSTKQISTGKPIDPSVKITNWSAKYFNGSNILGRGAKYVLSEGNKYLNLADGKLFLPTVLNNTYGQPQVSANGFISKNGGIHYLDKNGQEVKNRFKEISGSWYYFDSDGKMATGKTKIGNDTYLFMPNGKQLKEGVWYDGKKAYYYDDNGRTWTNKGFVEFRVDGQDKWRYFNGDGTIAIGLVSLDNRTLYFDAYGYQVKGQTVTINGKSYTFDADQGDLVQTDNANPAPQGQAGWKLLGDNQWGYRKDGQLLTGEQTIDGQKVFFQDNGVQVKGGTATDASGVLRFYDRDQGHQVGKGWYSTSDDNWVYVNESGQVLTGLQTIDGQTVYFDDKGIQAKGKAVWDENGNLRYFDADSGNMLRDRWKNVDGNWYYFNRNGLATRW

SEQ ID NO: 72 - protein, 1338 aa, Streptococcus criceti
MEKNLRYKLHKVKKQWVAIGVTTFAVGFLAGGQVVAADATDGNGGNTQVAHLIPKEPTDYKFDTPSGILTGLNFANAQTSPAGDNAGANQPAGGIEPQTAENAATDGQAVPQTSDQPGHLENVDGKTYYVDANGQRLKNYSTVIDGKTYYFDAQTGQAQAETPQINQNDNQVAPDTYAANNQAFTNDVSSFETVDNYVTADSWYRPRKILKNGESWQASAESDMRPILMTWWPDAATKAAYANYWVKEGLISGSYSPNSANLETAVQTIQAAIEKKIASEGSTAWLRDKMSQFVKSQNQWSLASENPTVYPNQDHLQGGALLFSNNEATAHANSDWRLLNRNPTFQTGKQKYFTTNYAGYELLLANDVDNSNPIVQAEQLNHFHYLMNWGEIVMGDKNANFDGVRVDAVDNVNADLLQIQRDYYKAKYGVDQNEKNAIDHLSILEAWSGNDNDYVKDQNNFSLSIDNSQRSYMLAAFAYPASQRGNDYISLLPKVGLKDRRYAKNGNPVPNYVFIRAHDSEVQTRIAKIIRERLGKTNADGLTNITLDDLNKAFDIYNQDMKAVDKQYYPNNLPMAYAWMLQNKDTVTRVYYGDMYTDDGQYMETKTPFHDAIETLLKARIKYVAGGQTAGYVQGWGSGILTSVRYGKGADTAIDAGTAETRTSGMAVLINNKPNFQSYNGLTLDMGAAHKNQAYRPLLLSTKDGIATYLNDSDVSSNQYKYTDGQGRLNFSASELRSVANVQVSGMIQVWVPVGAADNQDVRVAPNTNRNNSSNIYTQSDALDSQVIYEGFSNFQAFAKTPEQYTNAVIAKNADLFKSWGITQFEMAPQYVSSEDGTFLDSVVLNGYAFSDRYDLAMSKNNKYGSKEDLANAIKGLHNAGIKVLSDWVPDQMYNLPGKEVVTATRVDQYGRPKAGATINRTPYVVNTKTYGDYQEQYGGKFLDELQKLYPSLFTTKQISTGKPIDPSVKITNWSAKYFNGSNILGRGAKYVLSDNNKYLNLGAGQFFLPTNLNNTYGQPQAPANGFISKNGGIHYIDNNGQEVKNQFKEIAGSWYYFDANGKMATGQTKIGNTTYLFMPNGKQLKEGVWYDGKKAYYYDDNGRTWTNKGFVEFKVNGQDKWRYFNGDGSIAVGLVSLDNRTLYFDAYGYQVKGQTLTINGKTYSFDANEGDLITGNTPSPEPNNQGAWEALGDNQWGYRKDGKLLTGSQTIAGQKVFFQPNGVQVKGGTAKDEAGVLRFYDRDQGHLAGKGWYSTADNNWVYVDDAGRVVTGLQKIGSQTLYFDDNGIQAKGKAIWDKDGNLRYFAAGSGDMITNRWYNIGDNQWYWFNNQGIASRW

SEQ ID NO: 73 - protein, 1385 aa, Streptococcus criceti
MRSKKLWISLLFALTLIFTMAFSNMSAQAAGKDSVVTSNALSADQALVTSQTAVAEPQTVAEQQVVQTAPAAQADVAQSEVEESADLSVNKGADQANVTSQVSQAPAEAEESQLQTTQAAVAQPRAARQVNRLVQTKPETVKTDVNRLVAERPELTKPQLDNLNLSKLVQTPSANDFATNNQAYNNQASSFETVDNYLTADSWYRPKAILKDGQTWTLSGENDFRPILMSWWPDTATKAAYVNFWAKEGLVSGTYTQNSRNLDSAAQTIQAAIEKRISSEGNTTWLRNKMSQFVQAQSQWNIHSENPTAYPNQDHFQGGALLFSNNNATAYANSDWRLLNRNPSQQDGRVNYHKSSYGGYELLLANDVDNSNPIVQAEQLNHFHYLMNWGEIVMGDKEANFDGVRVDAVDNVDADLLQIQRDYYKAKYGVGQNEKNAIDHLSILEAWSGNDNDYVRDQDNFSLSIDNNQRSAMLRAFGYATAYRSDLSALATAGLKNRSKANSGDPIPNYVFIRAHDSEVQTRIASIIRERLGKANTDGLTNITLDDLEKAFAIYNKDMYATDKQYYINNLPMAYAWMLQNKDTVTRVYYGDMYTDDGQYMAAKTPFYNAIETMLKARIKYVAGGQTAAYNQDWNGGVLTSVRYGKGANSATDRGTSETRTSGMALLINNMPNFQAYRGVTLNMGAAHTNQAYRPLLLSTSTGIATYLNDSDVKSSQYKYTDSQGRLIFNASELHGVANAQVSGMIQVWVPVGAADNQDVRIAPSTSRNKSSDIYTQSDALDSQVIYEGFSNFQAFAKTPEQYTNAVIAKNADLFKSWGITQFEMAPQYVSSEDGTFLDSVVLNGYAFSDRYDLAMSKNNKYGSKEDLANAIKGLHKAGIKVLSDWVPDQMYNLPGKEVVTATRVDQYGRPKAGATINKTPYVVNTKTYGDYQEQYGGKFLDELQKLYPSLFTTKQISTGKPIDASVKITNWSAKYFNGSNILGRGAKYVLGDSKGYFNLTDSKLYLPTALLSKSTNPSQPSQPSQPSQPSKPSQPSKPSVSGISHDGKGYVYYKNGVQAKSSFITENNNLYYFDQKGYMVTGMQKINGATYYFGKDGKALKDGIYTDNAGKSYYFNSQGKRLENGYYPFGDKWRHFENGVMAVGLTQVKGKSKTYTQYYDAQGFQVKGELVTDKDGKVRYFDKQYGNMAINQFITNAQGKKSYFTGDGTRYENGYYQFGNKWRHFTNGIMDVGLTQVKGKYKTYTQFYDSYGFQVKGSFITDDNGKVRYFDKEYGNMVSNQFVKNSDGETFYFDKNGTAVTGWQVIDGQRLYFNANGVLVQRSRRSSNQIYERPRHQNRYSLNGYFYRYPRHTERNYYDYGFRNYGFRGYGFFDLQNFFPWDRF

SEQ ID NO: 74 - protein, 1385 aa, Streptococus criceti
MRSKKLWISLLFALTLIFTMAFSNMSAQAAGKDSVVTSNALSADQALVTSQTAVAEPQTVAEQQVVQTAPAAQADVAQSEVEESADLSVNKGADQANVTSQVSQAPAEAEESQLQTTQAAVAQPRAARQVNRLVQTKPETVKTDVNRLVAERPELTKPQLDNLNLSKLVQTPSANDFATNNQAYNNQASSFETVDNYLTADSWYRPKAILKDGQTWTLSGENDFRPILMSWWPDTATKAAYVNFWAKEGLVSGTYTQNSRNLDSAAQTIQAAIEKRISSEGNTTWLRNKMSQFVQAQSQWNIHSENPTAYPNQDHFQGGALLFSNNNATAYANSDWRLLNRNPSQQDGRVNYHKSSYGGYELLLANDVDNSNPIVQAEQLNHFHYLMNWGEIVMGDKEANFDGVRVDAVDNVDADLLQIQRDYYKAKYGVGQNEKNAIDHLSILEAWSGNDNDYVRDQDNFSLSIDNNQRSAMLRAFGYATAYRSDLSALATAGLKNRSKANSGDPIPNYVFIRAHDSEVQDRIASIIRERLGKANTDGLTNITLDDLEKAFAIYNKDMYATDKQYYINNLPMAYAWMLQNKDTVTRVYYGDMYTDDGQYMAAKTPFYNAIETMLKARIKYVAGGQTAAYNQDWNGGVLTSVRYGKGANSATDRGTSETRTSGMALLINNMPNFQAYRGVTLNMGAAHTNQAYRPLLLSTSTGIATYLNDSDVKSSQYKYTDSQGRLIFNASELHGVANAQVSGMIQVWVPVGAADNQDVRIAPSTSRNKSSDIYTQSDALDSQVIYEGFSNFQAFAKTPEQYTNAVIAKNADLFKSWGITQFEMAPQYVSSEDGTFLDSVVLNGYAFSDRYDLAMSKNNKYGSKEDLANAIKGLHKAGIKVLSDWVPDQMYNLPGKEVVTATRVDQYGRPKAGATINKTPYVVNTKTYGDYQEQYGGKFLDELQKLYPSLFTTKQISTGKPIDASVKITNWSAKYFNGSNILGRGAKYVLGDSKGYFNLTDSKLYLPTALLSKSTNPSQPSQPSQPSQPSKPSQPSKPSVSGISHDGKGYVYYKNGVQAKSSFITENNNLYYFDQKGYMVTGMQKINGATYYFGKDGKALKDGIYTDNAGKSYYFNSQGKRLENGYYPFGDKWRHFENGVMAVGLTQVKGKSKTYTQYYDAQGFQVKGELVTDKDGKVRYFDKQYGNMAINQFITNAQGKKSYFTGDGTRYENGYYQFGNKWRHFTNGIMDVGLTQVKGKYKTYTQFYDSYGFQVKGSFITDDNGKVRYFDKEYGNMVSNQFVKNSDGETFYFDKNGTAVTGWQVIDGQRLYFNANGVLVQRSRRSSNQIYERPRHQNRYSLNGYFYRYPRHTERNYYDYGFRNYGFRGYGFFDLQNFFPWDRF

SEQ ID NO: 75 - protein, 1587 aa, Streptococcus salivarius
MRSKKLWISLLFALTLIFTMAFSNMSASAEETNNSNGSPSTTTVGENTNPVVEKEVGTTTEVANTSNATTTERAEVTADKPAETTVQPNSGTTTSDRAVAVEVEAKPETTAKPEVATKPETATTSEVAANAGVAAPTTEKSKELSEAEIKAAVSLDNIKKEKDGKYYYLLEDGSHKKNFAITVNGQVLYFDENGALSSTSTYSFTQETTNLVTDFTKNNAAYDSTKASFELVDGYLTADSWYRPKEILEAGTTWKASTEKDFRPLLMSWWPDKDTQVAYLNYMTKALSNGEETKDVFTIENSQASLNAAAQILQRKIEVKIAANKSTDWLRQSIEAFVKDQDKWNINSESPGKEHFQKGALLFVNSDSTKWANSDYRKLNQTATSYIKNHKIVNGSDGGYEFLLSNDIDNSNPVVQAEMLNQLYYFMNWGQIVFGDKDKDAHFDGIRVDAVDNVSVDMLQLVSSYMKAAYKVNESEARALANISILEAWSHNDPYYVNEHNTAALSMDNGLRLSIVHGLTRPVTNKGTGARNASMKDLINGGYFGLSNRAEVTSYDQLGFATYLFVRAHDSEVQTVIADIISKKIDPTTDGFTFTLDQLKQAFDIYNADMLKVDKEYTHSNIPAAYALMLQTMGAATRVYYGDLYTDNGQYMAKKSPYFDQITTLLKARPKYVAGGQTSYIHNLAGDGVSSAKDNKEVLVSVRYGQDLMSKTDTEGGKYGRNSGMLTLIANNPDLKLADGETITVNMGAAHKNQAYRPLLLGTDKGIVSSLNDSDTKVVKYTDAQGNLVFTADEIKGFKTVDMSGYLSVWVPVGATDDQNVLAKPSTKAYKEGDKVYSSSAALEAQVIYEGFSNFQDFVKEDSQYTNKLIAANADLFKSWGITSFEIAPQYVSSKDGTFLDSIIENGYAFTDRYDFAMSKNNKYGSKEDLRDALKALHKQGIQVIADWVPDQLYTLPGKEVVTATRTDTHGKVLDDTSLVNKLYVTNTKSSGNDFQAQYGGAFLDKLQKLYPEIFKEVMEASGKTIDPSVKIKQWEAKYFNGTNIQKRGSDYVLSDGKLYFTVNDKGTFLPAALTGDTKAKTGFAYDGTGVTYYTTSGTQAKSQFVTYNGKQYYFNDKGYLVTGEQTIDGSNYFFLPNGVMFTDGVRKNAKGQSLVYGKSGKLTTQTGWKEVTVKDDSGKEEKFYQYFFKGGIMATGLTEVEGKEKYFYDNGYQAKGVFVPTKDGHLMFFCGDSGERKYSGFFEQDGNWYYANDKGYVATGFTKVGKQNLYFNEKGVQVKNRFFQVGDATYYANNEGDVLRGAQTINGDELYFDESGKQVKGEFVNNPDGTTSYYDAITGVKLVDTSLVVDGQTFNVDAKGVVTKAHTPGFYTTGDNNWFYADSYGRNVTGAQVINGQHLYFDANGRQVKGGFVTNTDGSRSFYHWNTGDKLVSTFFTTGHDRWYYADDRGNVVTGAQVINGQKLFFDTDGKQVKGAFATNANGSRSYYHWNTGNKLVSTFFTSGDNNWYYADAKGEVVVGEQTINGQHLYFDQTGKQVKGATATNPDGSISYYDVHTGEKAINRWVKIPSGQWVYFNAQGKGYVSN

SEQ ID NO: 76 - protein, 1646 aa, Lactobacillus animalis
MRSKKLWISLLFALTLIFTMAFSNMSAQAAGKDETSSSNETQTEQTLNTDESTDTTTDVSNEAKATEAQLTTQDADMASSEEKTTNVEKEVTTAETNKDTTVKNVESSEQNTTTVADKNAVDSTAQVNTAEKENKYTQENVNGNWYLKDEQGNYLTGFQEIKDQNKTVYYNPDSKQMVYGQQNINGNWYLFDTFNGAMQTGLQYIRDQKKLAYYNEQGQMQYGTVEIDGQKYQADTFNGAIKGKGQTKIADNWYLFNNAGQVVDGWQWINDQGKTVYYSTKTAQMVHGQQNINGHWYLFDKTTGAMQRGFQNLKAYGDDKTVYYNQDGWMLYGQQKIDNKWYNFDTFNGAMKTGFVKIPEQNKTVYYAPNGQMQYGWQWVDNATRYFDTFNGAMATGQKLITGHWYLFDNNGAMQRGFQNLKNYGDNKTVYYNQDGWMLYGWQWVNNATRYFDTFNGAMTTGQKKINDHWYLFDKDGAMQRGIQYIPEENKLVYYNQDGWMLYGKQNINGVDHNFNTFNGALEAKGQVKVGNNWYLFNNSGTIQTGFQDLKAYGQDKVVYYDPKTAAMVYGYQNIDGNWYLFSRANGSMQRGLQNVNGVDLLFDEKTGALLTGVQNIKGNNYFVDKRSGNIKKNLVVLGADNKWMYFDAKTGKGTNTLEDQYKKGVVSGNVEFITNNAAYSFDGNSFENINGFLTADSWYRPKSILKDGSTWTATTETDLRPLLMTWWPNEQIKANYLNYMKDKGFINNSGTYNAESDPNYMDFAAQEAQRNIERKITKENDTTWLRDLITDFIKTQDIWNEQSEGVSTEGLQKFQGGFLKYVNSELTPYANSEWRKLGYQPTMLTQNNVGAEFLLANDIDNSNPVVQAEQLNWLHFLMNFGTITANDPSANFDGIRIDAVDNVDASLLSIAGDYFKAAYKVGQNDATANKHISILEDWNDKDPEYVNSIGNPQLTMDDYIVQQLKFSLGQAPDKVDRMQRFKEWYLVDRSKDNTENTAIPNYSFVRAHDASVQEDILQLIQDTTGKPWGVYTNEELQQGLKDYMADQKLTNKKYNRYNIPSSYAILLTNKDTIPRVYYGDLYSDAGKYMAEKSIYFDAIDNLLKTRTKYVAGGQTLDVDGHDILTSVRFGKGALNVTDKGTSETRTQGMGLIISNNNSLKLNDGEKVVLHMGAAHKNQAYRAVMLSSANGLINYTSDANAPVVYTNNDGDLIFTNKDVVTNGKVQANTAIKGVMNPYVSGYLAMWVPVGASATQDARTAASTKTTTDGSVFHSNAALDSNLIYEGFSNFQAFPENASENANAIIAQNVDLFNSWGVTSFQLAPQYVSSHDGSFLDSIIDNGYAFTDRYDLAMSKNNKYGSYQDLVNVLKALHAGGIQVIADWVPDQIYSLPGKEVVSVVRSDEFGNKVDGTQIDNTLYVVNTIGGGQYQKEYGGRYLEELKQKYPELFKTKQPSTGVTIDPSEKITEWSAKYLNGTNILHRGAEFVLRDGATYFRVAETSEVFLPSQLRGKITKNGFWKNDAGKVNYYNSEGEIMKNAFVKDGKNNWYYFDNDGNMVTNTALTIDSDAQVADYYFLNNGISLRDGFVQLANGDIYYYDVNGRKLKNGKVTVNNVEYTTDKNGKVVGENVLKKLDEIITTGKTTLI

SEQ ID NO: 77 - protein, 1574 aa, Streptococcus gordonii
MRSKKLWISLLFALTLIFTMAFSNMSAQAAGKLESGVIYADDANQVTNVKEQSAVQSKDSEQTTSDKATDSSQLEVKEQASSSKETYQASAATNPTANEQTTQQDKEVETSRTDSRHELTQKTSDDSSEKSGSSQEPKVADQAESTDKTQAALQAKQDSRANDQEETTENVAKATVSDKIIATPKKERLPEPAQRKESITEKMLAAQAQAAPVNTEHDDDVLAHIKTIDGKKYYVQDDGTVKKNFAVELNGKILYFDAETGALVDSNEYQFQQGTSSLNNEFTQKNAFYGTTDKDIETVDGYLTADSWYRPKFILKDGKTWTASTETDLRPLLMAWWPDKRTQINYLNYMNQENLGIGAFESKTEQVLLTNAVQQVQRKIEERISKEGDTKWLRTLMSAFVKTQPNWNIKTESETTGTNKDHLQGGALLYTNSDKTSHANSRYRLLNRTPTSQTGTPKYFIDKSNGGYEFLLANDFDNSNPAVQAEQLNWLHYMMNFGSIVANDPTANFDGVRVDAVDNVNADLLQIASDYFKSRYKVGESEEEALKHLSILEAWSDNDPDYNKDTKGAQLAIDNKLRLSLLYSFMRKLSIRSGVEPTITNSLNDRSTENKNGERTANYIFVRAHDSEVQTVIADIIRENINPNTDGLTFTMDELKQAFKIYNEDMRKADKKYTQFNIPTAHALMLSNKDSITRVYYGDLYTDDGQYMEKKSPYHDAIDALLRARIKYVAGGQDMKVTYMGVPREADKWSYNGILTSVRYGTGANEATDEGTAETRTQGMAVIASNNPNLKLNEWDKLQVNMGAAHKNQYYRPVLLTTKDGISRYLTDEEVPQSLWKKTDANGILTFDMNDIAGYSNVQVSGYLAVWVPVGAKENQDARVTASKKKNASGQVYESSPALDSQLIYEGFSNFQDFATRDDQYTNKVIAKNVNLFKEWGVTSFELPPQYVSSQDGTFLDSIIQNGYAFEDRYDMAMSKNNKYGSLDDLLNALRALHSVNIQAIADWVPDQIYNLPGKEVVTATRVNNYGTYREGAEIKEKLYVANSKTNGTDYQGKYGGAFLDELKAKYPEIFERVQISNGQKMTTDEKITKWSAKYFNGTNILGRGAYYVLKDWGSKEYLSNKNGETALPKQLVNKEASTGFVKDTNGFKFYSTSGNQAKDTFIQDENGNWYYFDNQGYLVTGAREIDGKQLYFMKNGVQLRDALQEDENGNQYYYDKTGAKVLNRYYTSDGQNWRYFDAKGVMARGLVKIGDGQQYFDQNGYQVKGKVVRAKDGKLRYFDKDSGNAVINRFAQGDNPSDWYYFGADGVALTGLQKIGQQTLYFGQDGKQVKGQVVMLADKSIRYFDANSGEMAVNKFAEGAKNEWYYFDQDGKAVTGLKTINNQVLYFDQDGKQVKGQVVTLADKSIRYFDANSGEMAVNKFAEGAKNEWYYFDQDGKAVTGLQTINKQVLYFGQDGKQVKGQVVTLADKSIRYFDANSGEMAVNKFAEGAKNEWYYFDQDGKAVTGLKTINNQVLYFGQDGKQVKGQVVYVDGAERYFDPKSGDMVRNKWIRLEDGTWMYFDRNGRGRRFGRN

SEQ ID NO: 78 - protein, 1414 aa, Streptococcus sobrinus
MRSKKLWISLLFALTLIFTMAFSNMSASAIDGKYYYVQADGSYKKNFAITVNGQMLYFDSDTGALSSTSTYSFSQGTTNLVDDFSSHNKAYDSTAKSFELVNGYLTANSWYRPAGILRNGQTWEASNENDLRPVLMSWWPDKDTQVAYVNYMNKYLSANETEVTNETSQVDLNKEAQSIQTKIEQKITSDNSTQWLRTAMEAFVAAQPKWNMSTENFNKGDHLQGGALLYTNSDLTPWANSDYRLLNRTPTQQDGTKKYFTEGGEGGYEFLLSNDVDNSNPVVQAEQLNQLHYLMNWGDIVMGDKDANFDGVRVDAVDNVNADLLQVYSNYFKDNYKVTDSEANALAHISILEAWSLNDNQYNEDTNGTALSIDNSSRLTSLAVLTKQPGQRIDLSNLISESVNKERANDTAYGDTIPTYSFVRAHDSEVQTVIAKIVKEKIDTNSDGYTFTLDQLKDAFKIYNEDMAKVNKTYTHYNIPAAYALLLSNMESVPRVYYGDLYTDDGQYMAKKSPYYDAIATMLQGRIAYVSGGQSEEVHKVNGNNQILSSVRYGQDLMSADDTQGTDLSRTSGLVTLVSNDPNLDLGGDSLTVNMGRAHANQAYRPLILGTKDGVQSYLKDSDTNIVKYTDANGNLTFTADDIKGYSTVDMSGYLAVWVPVGAKDGQDVRVAADTNQKADGKSLKTSAALDSQVIYEGFSNFQDFANNDADYTNKKIAENADFFKKLGITSFEMAPQYVSATDGSFLDSIIQNGYAFSDRYDLAMSKNNKYGSKDDLANALKALHANGIQAIADWVPDQIYQLPGEEVVTAKRTNSYGNPTFDAYINNALYATNTKSSGSDYQAQYGGAFLDELKAKYPDMFTVNMISTGKPIDPSTKIKQWEAKYFNGTNVLGKGAGYVLSDDATGKYFTVNENGDFLPASFTGDQNAKTGFYYDGTGMAYYSTSGNKAVNSFIYEGGHYYYFDKDGHMVTGSYKAEDGNDYYFLPNGIQMRDAIYQDAQGNSYYYGRTGILYKGDNWYPFVDPNNANKTVFRYFDANNVMAIGYRNMYGQTYYFDENGFQAKGQLLTDDKGTHYFDEDNGAMAKNKFVNVGDDWYYMDGNGNAVKGQYPVNNQILYFNPETGVQVKGQFITDAQGRTSYYDANSGALKSSGFFTPNGSDWYYAENGYVYKGFKQVAENQDQWYYFDQTTGKQAKGAAKVDGRDLYFNPDSGVQVKGDFATDESGNTSFYHGDNGDKVVGGFFTTGNNAWYYADNNGNLVKGFQEIDGKWYHFDEVTGQQAKGAALVNGQQLYFDVDSGIQVKGDFVTDGQGNTSYYDVNSGDKKVNGFFTTGDNAWYYADGQGNLAKGRKSIDNQDLYFDPATGKQVKGQLVSIDGRNYYFDSGSGNMAKNRFVRIGDQWIYFGNDGAATNL

SEQ ID NO: 79 - protein, 1597 aa, Streptococcus downei
MEKNERFKMHKVKKRWVTISVASATMLASALGASVASADTETVSEDSNQAVLTADQTTTNQDTEQTSVAATATSEQSASTDAATDQASATDQASAAEQTQGTTASTDTAAQTTTNANEAKWVPTENENQVFTDEMLAEAKNVATAESNSIPSDLAKMSNVKQVDGKYYYYDQDGNVKKNFAVSVGEKIYYFDETGAYKDTSKVEADKSGSDISKEETTFAANNRAYSTSAENFEAIDNYLTADSWYRPKSILKDGKTWTESSKDDFRPLLMAWWPDTETKRNYVNYMNKVVGIDKTYTAETSQADLTAAAELVQARIEQKITTEQNTKWLREAISAFVKTQPQWNGESEKPYDDHLQNGALKFDNQSDLTPDTQSNYRLLNRTPTNQTGSLDSRFTYNANDPLGGYELLLANDVDNSNPIVQAEQLNWLHYLLNFGTIYAKDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDLIRDIIKAEINPNAFGYSFTQDEIDQAFKIYNEDLKKTDKKYTHYNVPLSYTLLLTNKGSIPRVYYGDMFTDDGQYMANKTVNYDAIESLLKARMKYVAGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQASNKYLNVSDDKLFLPKTLLGQVVESGIRFDGTGYVYNSSTTGEKVTDSFITEAGNLYYFGQDGYMVTGAQNIKGSNYYFLANGAALRNTVYTDAQGQNHYYGNDGKRYENGYQQFGNDSWRYFKNGVMALGLTTVDGHVQYFDKDGVQAKDKIIVTRDGKVRYFDQHNGNAVTNTFVADKTGHWYYLGKDGVAVTGAQTVGKQHLYFEANGQQVKGDFVTAKDGKLYFYDVDSGDMWTNTFIEDKAGNWFYLGKDGAAVTGAQTIKGQKLYFKANGQQVKGDIVKDADGKIRYYDAQTGEQVFNKSVSVNGKTYYFGSDGTAQTQANPKGQTFKDGSGVLRFYNLEGQYVSGSGWYETAEHEWVYVKSGKVLTGAQTIGNQRVYFKDNGHQVKGQLVTGNDGKLRYYDANSGDQAFNKSVTVNGKTYYFGSDGTAQTQANPKGQTFKDGSGVLRFYNLEGQYVSGSGWYKNAQGQWLYVKDGKVLTGLQTVGNQKVYFDKNGIQAKGKAVRTSDGKVRYFDENSGSMITNQWKFVYGQYYYFGSDGAAVYRGWN

SEQ ID NO: 80 - DNA, 4311 bp, Streptococcus downei
atggttgacggcaaatactactactacgatcaggacggcaacgtaaagaaaaacttcgcggttagcgtgggcgagaaaatctattactttgacgaaactggcgcctacaaagacaccagcaaagttgaggcggacaaaagcggcagcgacattagcaaggaagagactaccttcgcggcaaacaaccgcgcctacagcaccagcgcggagaattttgaggcgatcgacaattatctgaccgcggactcctggtatcgtcctaaatccatcctgaaggatggcaaaacgtggacggaaagcagcaaagatgactttcgtccgctgctgatggcgtggtggccggataccgaaacgaagcgcaattacgtgaactacatgaacaaagttgttggcatcgacaagacctataccgcggaaaccagccaggccgacttgaccgctgcggcggaactggtgcaagcacgcattgagcagaagatcacgaccgaacagaacacgaaatggctgcgtgaggcaatctcggcatttgttaaaacgcaaccgcagtggaacggtgaaagcgagaagccgtacgacgatcacctgcaaaacggtgctctgaaatttgataatcagagcgacctgaccccggatacgcaaagcaactaccgtctgttgaaccgtaccccgactaatcagacgggtagcctggacagccgcttcacttataacgcgaacgaccctttgggcggttatgagctgctgctggcaaatgacgtcgataacagcaatccgatcgtgcaggcggagcagctgaactggctgcattacctgctgaattttggtacgatctacgccaaagatgccgacgctaacttcgatagcattcgtgtggacgcggttgataacgtcgatgcggatctgctgcaaattagcagcgattacctgaaagcagcctacggcattgataagaataacaaaaacgcgaacaaccacgtgagcattgtcgaagcctggagcgataatgataccccgtacctgcatgacgatggtgacaacctgatgaatatggataacaaatttcgcctgtccatgctgtggtcgctggccaaaccgctggacaagcgtagcggtctgaacccgctgattcataacagcttggtggatcgtgaagttgatgaccgcgaggttgaaacggttccgagctattcttttgcacgtgcgcatgatagcgaggtccaggacttgatccgtgacatcatcaaggcagagatcaatccgaacgcattcggttatagctttacccaagacgagattgaccaggcctttaagatttacaatgaggatctgaagaaaacggataagaaatacacccactataatgtgccgttgagctacaccctgctgctgacgaataagggtagcatcccacgtgtctactatggtgatatgtttaccgacgatggtcagtatatggcgaacaaaaccgtcaactatgacgccattgaatctctgctgaaagcgcgtatgaagtatgtcgctggcggtcaagcaatgcagaactaccaaatcggtaatggtgagatcctgaccagcgttcgttatggtaagggtgccctgaaacagagcgacaaaggtgatgcgaccacgcgcaccagcggtgtcggtgtcgttatgggcaatcagccaaactttagcttggacggcaaagtggtggctctgaacatgggcgcagctcatgcgaatcaggagtatcgtgcgctgatggttagcacgaaagacggtgttgccacgtatgcgaccgatgcagatgcgagcaaagccggtctggtcaaacgtaccgacgaaaacggctacctgtatttcctgaatgacgacctgaagggtgtggccaatcctcaggtgagcggtttcttgcaggtgtgggttccggtgggtgccgcggatgatcaagatatccgtgttgcagctagcgataccgcatccaccgatggcaagagcctgcaccaagacgccgcgatggatagccgtgttatgtttgaaggcttctctaactttcagtcctttgccacgaaagaagaggaatataccaacgtcgttatcgccaacaatgtggataagttcgttagctggggtatcacggatttcgagatggccccacaatatgtttccagcaccgacggtcaattcctggactctgtcattcagaacggttatgcttttacggaccgttatgacttgggcatgtctaaggcaaacaaatacggcacggccgatcaactggttaaggccattaaggccctgcacgcgaagggcctgaaggttatggcagattgggtgccggatcagatgtataccttcccgaaacaggaagtcgtgaccgttacccgtaccgacaaatttggcaaaccgatcgcaggttcccaaatcaatcatagcctgtatgttaccgataccaagtccagcggcgatgactatcaggccaaatatggtggtgcgtttctggacgagctgaaggagaaatatccggagctgttcacgaagaaacaaatcagcacgggtcaagctattgacccgagcgtgaaaatcaaacagtggtctgctaagtatttcaatggctccaacatcctgggtcgcggtgcggactacgtactgtcggatcaggcgagcaacaaatacctgaacgtgtctgacgataaactgttcctgccgaaaaccttgctgggccaagttgtcgagagcggtatccgctttgacggcactggttatgtgtacaactctagcactacgggtgaaaaagttaccgattccttcattacggaggcaggtaatctgtactacttcggtcaagacggctatatggtgaccggcgcacagaacattaagggcagcaactattacttcctggccaatggtgcggccctgcgtaacaccgtttacaccgatgcgcaaggtcagaatcactattacggcaacgacggcaagcgttatgagaatggttaccaacagttcggcaacgattcttggcgttacttcaaaaatggcgtgatggcgctgggtctgactacggtggatggtcacgtgcagtatttcgataaagatggtgtccaggccaaggataagatcattgtcacccgcgatggcaaagtccgctatttcgaccagcacaacggtaatgcggttactaacacgttcgttgcggacaagacgggtcactggtactatctgggcaaagacggcgtcgcggttaccggtgcgcagactgtgggtaaacagcatttgtactttgaagcgaacggtcaacaagtcaagggtgacttcgtgacggctaaagacggtaaactgtacttctatgatgtggacagcggcgacatgtggaccaatacctttatcgaggataaagcgggtaattggttctacctgggtaaggacggtgcggccgtcaccggtgcacagacgatcaaaggccagaaattgtatttcaaagccaacggtcagcaagttaaaggtgacattgtcaaggacgcggacggtaagatccgttattacgacgctcagaccggtgaacaggtctttaacaagtccgttagcgtcaacggtaagacctactatttcggtagcgacggcaccgcgcaaacccaggcgaatccgaaaggccaaacctttaaggatggtagcggcgttctgcgtttctacaatttggagggccagtatgtctcgggcagcggctggtacgaaacggccgagcacgagtgggtatatgtgaaatccggtaaagttctgaccggtgcccagacgattggtaatcaacgtgtttacttcaaggacaatggtcaccaggtgaaaggccagctggtcacgggtaatgacggtaaattgcgttactacgacgcgaacagcggtgatcaagcattcaacaaatccgtcacggttaacggtaaaacctactactttggcagcgatggtacggcgcagacgcaggctaatcctaagggtcagaccttcaaagatggtagcggcgtgctgcgtttttacaacttggaaggccaatacgtgtctggcagcggttggtacaagaatgcgcagggccagtggctgtacgtgaaagatggcaaggtcctgaccggtctgcaaacggtcggcaatcagaaggtctacttcgacaaaaatggcatccaagcaaagggtaaggccgttcgcacgtccgatggtaaagtgcgctactttgatgagaatagcggtagcatgattacgaaccaatggaagttcgtttacggtcaatactattacttcggttctgacggcgcagcggtttaccgtggttggaactaa

SEQ ID NO: 81 - protein, 1436 aa, Streptococcus downei
MVDGKYYYYDQDGNVKKNFAVSVGEKIYYFDETGAYKDTSKVEADKSGSDISKEETTFAANNRAYSTSAENFEAIDNYLTADSWYRPKSILKDGKTWTESSKDDFRPLLMAWWPDTETKRNYVNYMNKVVGIDKTYTAETSQADLTAAAELVQARIEQKITTEQNTKWLREAISAFVKTQPQWNGESEKPYDDHLQNGALKFDNQSDLTPDTQSNYRLLNRTPTNQTGSLDSRFTYNANDPLGGYELLLANDVDNSNPIVQAEQLNWLHYLLNFGTIYAKDADANFDSIRVDAVDNVDADLLQISSDYLKAAYGIDKNNKNANNHVSIVEAWSDNDTPYLHDDGDNLMNMDNKFRLSMLWSLAKPLDKRSGLNPLIHNSLVDREVDDREVETVPSYSFARAHDSEVQDLIRDIIKAEINPNAFGYSFTQDEIDQAFKIYNEDLKKTDKKYTHYNVPLSYTLLLTNKGSIPRVYYGDMFTDDGQYMANKTVNYDAIESLLKARMKYVAGGQAMQNYQIGNGEILTSVRYGKGALKQSDKGDATTRTSGVGVVMGNQPNFSLDGKVVALNMGAAHANQEYRALMVSTKDGVATYATDADASKAGLVKRTDENGYLYFLNDDLKGVANPQVSGFLQVWVPVGAADDQDIRVAASDTASTDGKSLHQDAAMDSRVMFEGFSNFQSFATKEEEYTNVVIANNVDKFVSWGITDFEMAPQYVSSTDGQFLDSVIQNGYAFTDRYDLGMSKANKYGTADQLVKAIKALHAKGLKVMADWVPDQMYTFPKQEVVTVTRTDKFGKPIAGSQINHSLYVTDTKSSGDDYQAKYGGAFLDELKEKYPELFTKKQISTGQAIDPSVKIKQWSAKYFNGSNILGRGADYVLSDQASNKYLNVSDDKLFLPKTLLGQVVESGIRFDGTGYVYNSSTTGEKVTDSFITEAGNLYYFGQDGYMVTGAQNIKGSNYYFLANGAALRNTVYTDAQGQNHYYGNDGKRYENGYQQFGNDSWRYFKNGVMALGLTTVDGHVQYFDKDGVQAKDKIIVTRDGKVRYFDQHNGNAVTNTFVADKTGHWYYLGKDGVAVTGAQTVGKQHLYFEANGQQVKGDFVTAKDGKLYFYDVDSGDMWTNTFIEDKAGNWFYLGKDGAAVTGAQTIKGQKLYFKANGQQVKGDIVKDADGKIRYYDAQTGEQVFNKSVSVNGKTYYFGSDGTAQTQANPKGQTFKDGSGVLRFYNLEGQYVSGSGWYETAEHEWVYVKSGKVLTGAQTIGNQRVYFKDNGHQVKGQLVTGNDGKLRYYDANSGDQAFNKSVTVNGKTYYFGSDGTAQTQANPKGQTFKDGSGVLRFYNLEGQYVSGSGWYKNAQGQWLYVKDGKVLTGLQTVGNQKVYFDKNGIQAKGKAVRTSDGKVRYFDENSGSMITNQWKFVYGQYYYFGSDGAAVYRGWN

SEQ ID NO: 82 - protein, 1597 aa, Streptococcus dentrirousetti; identical to SEQ ID NO: 79

SEQ ID NO: 83 - DNA, 3972 bp, Streptococcus dentirousetti
atggttgacggcaaatactactactacgatgcagacggcaacgtaaagaaaaacttcgcggttagcgttggcgatgccattttctattttgatgaaacgggtgcctacaaagataccagcaaagttgatgcggataagaccagctctagcgtcaatcagaccacggaaacgttcgcagcgaataaccgtgcgtatagcaccgcagccgagaactttgaagcgattgataactacctgactgcggatagctggtatcgtccgaagtctatcttgaaagatggtacgacgtggaccgaaagcaccaaggatgattttcgcccgctgctgatggcgtggtggccggataccgaaaccaaacgtaactacgtgaactatatgaacaaggtggtcggtatcgacaaaacgtacaccgcggaaacgtcccaagctgacctgacggcggcagccgaactggtgcaggcgcgtatcgagcagaaaatcactagcgaaaagaatacgaagtggctgcgtgaggcgatttccgcgttcgttaagactcaaccgcagtggaatggcgagagcgagaaaccttatgatgaccacctgcaaaatggtgcgctgaagttcgacaatgaaaccagcctgaccccggatacgcagagcggctatcgcatcctgaaccgtaccccgacgaatcaaaccggtagcctggacccgcgcttcacctttaatcagaatgacccgctgggtggttatgagtatttgctggctaatgatgtcgataacagcaacccggtcgttcaggccgagagcctgaactggctgcattacctgctgaattttggtagcatttacgcgaatgatccggaggccaatttcgacagcatccgtgtggacgcggtggacaatgttgacgcagacctgctgcaaattagctcggattacctgaaatcggcgtacaaaattgacaagaacaacaaaaatgcgaacgaccacgttagcatcgtcgaggcgtggagcgacaatgataccccgtacctgaatgatgatggcgacaatctgatgaacatggataacaagtttcgtctgagcatgctgtggagcctggcgaagccaaccaatgtccgtagcggcttgaatccgctgatccacaacagcgtggttgaccgtgaggtggacgaccgtgaagttgaggctaccccgaattacagctttgcacgcgcacacgacagcgaagttcaagatttgattcgcgacatcatcaaagctgagatcaacccaaacagcttcggttatagctttacccaagaggaaatcgaccaggccttcaagatctacaatgaggatttgaagaaaaccaataagaagtatacccactacaacgtcccgctgagctacaccctgctgctgacgaacaagggcagcattccacgcatttactacggtgacatgtttacggatgacggtcagtatatggccaacaaaaccgttaactatgacgccattgagagcctgctgaaagcacgtatgaagtatgttagcggtggccaagcgatgcagaattacaacatcggcaacggcgagattctgaccagcgtccgttacggtaagggtgccctgaaacagagcgacaaaggcgataagactactcgtaccagcggtattggcgttgtgatgggtaaccagagcaatttcagcctggagggcaaggtggtggccctgaatatgggtgcaacgcataccaaacagaagtatcgtgcattgatggtgtctacggaaaccggcgtggcgatttacaatagcgatgaagaagcagaggcagcaggcctgatcaaaacgaccgatgagaatggttatttgtactttctgaatgacgatctgaagggcgtggctaacccgcaggtcagcggcttcctgcaagtgtgggttccggttggtgcaccggctgaccaggacattcgtgtggcggcgaccgatgcggcttctaccgacggtaagagcctgcatcaggacgcagctctggattctcgcgtcatgtttgaaggtttcagcaacttccagagcttcgcaaccaaggaagaggaatacaccaacgttgttattgcaaagaacgtggataagttcgtgagctggggtatcaccgacttcgagatggcaccgcagtacgttagctctaccgatggcacctttctggatagcgtgattcaaaatggctatgcctttacggaccgttacgacctgggtatgagcaaagcaaacaagtatggtactgctgaccaactggtggccgcgattaaagcgctgcatgcgaagggtctgcgtgtgatggcggattgggtcccagatcaaatgtacactttccctaagaaggaagtggttaccgttacccgtacggacaaatttggcaatccagtggcaggcagccaaatcaaccacaccttgtacgtcactgatactaagggtagcggtgacgactaccaggcgaagtacggtggcgcattcctggatgaactgaaagaaaagtacccggagctgtttaccaagaagcaaatcagcaccggtcaggcaatcgacccgagcgtgaaaatcaagcagtggagcgcgaagtacttcaacggtagcaatatcttgggtcgcggtgcgaactacgtgctgtccgaccaggcgtctaacaagtactttaacgtggccgaaggtaaagtctttctgccagcggcgatgctgggtaaggtcgtcgagagcggtatccgtttcgacggtaaaggttatatctataacagcagcaccactggcgaacaagtgaaggacagcttcattaccgaagcgggtaacttgtactattttggcaaagatggttatatggtcatgggtgcacagaatatccagggtgctaactactacttcttggcgaatggtgcggccctgcgcaatagcatcctgacggatcaggatggcaaaagccactattatgcaaatgacggcaagcgttatgagaacggctactatcaattcggtaacgactcctggcgctattttgaaaacggcgttatggccgttggtttgacgcgcgttgcgggccacgaccaatactttgataaggatggtatccaagcgaagaataagatcattgttacgcgtgacggtaaggtccgctacttcgacgaacacaacggcaatgctgccacgaatacgtttatcagcgatcaagccggccattggtactacctgggtaaagatggtgtcgccgtgacgggtgcgcagaccgttggcaagcaacacctgtacttcgaggctaacggccaacaagtaaaaggcgattttgttaccgccaaggacggtaagttgtattttctggacggtgactctggcgacatgtggaccgataccttcgtccaggataaggctggtcattggttctatctgggcaaagacggtgcggcggtaaccggtgcccagaccgtccgtggtcagaagctgtacttcaaagcgaatggccagcaggttaagggtgacattgtgaaaggcgcggatggtaaaatccgttactatgatgcaaattccggtgaccaggtttacaatcgcacggtgaaaggctccgacggcaagacctatatcattggtaatgacggcgtcgcaatcacgcaaaccatcgccaaaggccagaccatcaaggatggcagcgttctgcgcttctatagcatggagggtcagctggtgaccggcagcggctggtattccaacgcgaaaggtcaatggttgtatgtcaagaacggtcaagtcctgacgggtttgcagacggtgggcagccagcgtgtgtactttgacgcaaatggtattcaagcgaaaggtaaagcagtgcgtacctccgatggcaaactgcgttacttcgatgcgaacagcggcagcatgatcaccaatcagtggaaagaagttaatggtcagtactactatttcgacaacaacggtgttgcgatctatcgcggttggaactaa

SEQ ID NO: 84 - protein, 1323 aa, Streptococcus dentirousetti
MVDGKYYYYDADGNVKKNFAVSVGDAIFYFDETGAYKDTSKVDADKTSSSVNQTTETFAANNRAYSTAAENFEAIDNYLTADSWYRPKSILKDGTTWTESTKDDFRPLLMAWWPDTETKRNYVNYMNKVVGIDKTYTAETSQADLTAAAELVQARIEQKITSEKNTKWLREAISAFVKTQPQWNGESEKPYDDHLQNGALKFDNETSLTPDTQSGYRILNRTPTNQTGSLDPRFTFNQNDPLGGYEYLLANDVDNSNPVVQAESLNWLHYLLNFGSIYANDPEANFDSIRVDAVDNVDADLLQISSDYLKSAYKIDKNNKNANDHVSIVEAWSDNDTPYLNDDGDNLMNMDNKFRLSMLWSLAKPTNVRSGLNPLIHNSVVDREVDDREVEATPNYSFARAHDSEVQDLIRDIIKAEINPNSFGYSFTQEEIDQAFKIYNEDLKKTNKKYTHYNVPLSYTLLLTNKGSIPRIYYGDMFTDDGQYMANKTVNYDAIESLLKARMKYVSGGQAMQNYNIGNGEILTSVRYGKGALKQSDKGDKTTRTSGIGVVMGNQSNFSLEGKVVALNMGATHTKQKYRALMVSTETGVAIYNSDEEAEAAGLIKTTDENGYLYFLNDDLKGVANPQVSGFLQVWVPVGAPADQDIRVAATDAASTDGKSLHQDAALDSRVMFEGFSNFQSFATKEEEYTNVVIAKNVDKFVSWGITDFEMAPQYVSSTDGTFLDSVIQNGYAFTDRYDLGMSKANKYGTADQLVAAIKALHAKGLRVMADWVPDQMYTFPKKEVVTVTRTDKFGNPVAGSQINHTLYVTDTKGSGDDYQAKYGGAFLDELKEKYPELFTKKQISTGQAIDPSVKIKQWSAKYFNGSNILGRGANYVLSDQASNKYFNVAEGKVFLPAAMLGKVVESGIRFDGKGYIYNSSTTGEQVKDSFITEAGNLYYFGKDGYMVMGAQNIQGANYYFLANGAALRNSILTDQDGKSHYYANDGKRYENGYYQFGNDSWRYFENGVMAVGLTRVAGHDQYFDKDGIQAKNKIIVTRDGKVRYFDEHNGNAATNTFISDQAGHWYYLGKDGVAVTGAQTVGKQHLYFEANGQQVKGDFVTAKDGKLYFLDGDSGDMWTDTFVQDKAGHWFYLGKDGAAVTGAQTVRGQKLYFKANGQQVKGDIVKGADGKIRYYDANSGDQVYNRTVKGSDGKTYIIGNDGVAITQTIAKGQTIKDGSVLRFYSMEGQLVTGSGWYSNAKGQWLYVKNGQVLTGLQTVGSQRVYFDANGIQAKGKAVRTSDGKLRYFDANSGSMITNQWKEVNGQYYYFDNNGVAIYRGWN

SEQ ID NO: 85 - protein, 1284 aa, Gluconobacter oxydans
MADNSDEQFVASDYTLLGDATDDPNGMVDMPAGQEPATTNAVPSGVEYNFLAATAGYYTVSFAYQNTANAAAYEQLSINGQNEPGVVEFDQTSGASTGTAYASVYLKAGLNSVELNNQTTDETNGLTPVPEDQLQASPAFQIGTSTVAAGASPSQETSAQSLAISNQTDMQAFVQGESMAPKQQWTFGPSLSELHVGSNDELNQLDFNAVWFRNVTPGQQAETYSPYFKSNESFDANGVLHVNYGAYSPTGQALPVQIQATYANVPNENLIVENLSLTNQNASGTQPLVWDVMNATGINPGEVSSTTWDPTHNAWIVTEDQGSGKSPLYLAIGDYQVSNSTHAAGVDGVNVRGSYSLSSGASGNPSLNAPDQGVIGGFENNGTMVGSSSGASGTNLAVGTTDSDVTLNPGQTVDLSYYLSTATSLSQLDANLDKYTNTVGSTTSSTPMTDATGASAASSWTQQTATAWDDTLNQAYNLAGSTETSGQAATAASGQTLDPTSSAAAQSAYRSSLINILQAQSPEYGSFMASTNPSYEYKVWVRDSAATAIGLDDAGLTQPADKFWRWMASVEQNGMNATYSGNASGTFSTNYGEFDQNLPIGFVAPENDSQGLFLIGSYRHYEQMLSEGQTQQAQSFISDPTVRQALVNSANWIQENIGSNGLGPADYSIWEDMYGYHTFTQVTYAEGLNAASQLASAMGEGNQAQTWATGAETIKDAILRPTTASTPGLWNAQEGHFVEMINPNGTIDNTIDADTNIAAVFGLVSPTSIYATENAQAVENALTQDNFGLSRYQNETFYQSSQWSPGGTYEAQGISPSWPQMTAYDSIVSMDSGNTTQANNDLSWIEQSYDNGGTPPGESYDWARGQPIESTSSEPVTASWYVQDLLNSTGQTSTLMPAITGQAPTATPQTDVSVNTGTTGFGSYTLGLDSVGNSQAQDMIVGTGNTSATSVAMVRNEAAAGTPETIDNTNGVNDLLVFGNAGDTNVLAGQNSTTTIMNNAAGDHGTVEYTGATGASATILAGPLTEIQAAGTTNLIMGSQSDTTTSDAYITGGQYDSADQTNITTEGPAGQLDAIDNQGNAHTTLQVASPTDLLYTGRDTTLNLGTDGQKSTINSLGNDQIHMNGSNVNVASVTGGFDTFYGGTGTMTINASQSVGYTQETYIGSQTSGGSLTYTGGNAANQITLGDESSVAITAGAGAMNITANDSTGLWANLTNAASADLNFGSSLGNSMIYGFNGSTDSATMQGVTGTSFSGGNLMVSLADNHSITFFDVHTLQGMNIVGA

SEQ ID NO: 86 - DNA, 4179 bp, Streptococcus sp. C150
atcaacggcaaacaatactatgtcaatagtgacggtagtgtgcgtaagaacttcgtttttgagcaagatggtaagtcatattactttgatgctgaaacaggggctcttgcgaccaagtcacaggatgaattttcaacagaacctatcaaggcagctgtggatttttcatctggaaatcagctctacaaaaacgataacaaatctttggaccaactcgacaccttcatcactgcggatgcttggtaccgtccaaagagtattctcaaggatggtaagacttggacagcttcaactgaagcggacaaacgtcctctcttgatggtttggtggcctgacaaatcgactcaggttaactaccttaactacatgcaaaatcaaggtcttggtgcgggatcattttcaaccaactctagccaggaaagtctaaatctagctgctaaagcggttcagactaagattgaagaacgtattgcgcgtgaaggcaataccaactggttgcgtacaagtatcgaccagttcatcaagactcagccaggttggaatagtagcactgaaaatagttcttatgaccacttacaaggcggacagttgctctttaacaacagtaagggtgatactggtaaccgtactagctacgccaactctgattatcgtttgcttaaccgcacaccgacaaaccagagtgggacacgtaagtatttcaaggataattctatcggtggtcttgagttcttgcttgccaacgatattgacaactcaaacccagctgttcaggcggagcaacttaactggctccactttatgatgaatattggaagcatcatggccaatgacccaacagccaactttgacggtttgcgtgtcgatgctttggacaatgtggatgccgaccttctccaaatcgcttcagattacttcaaagcagtctatggtgttgacaagtccgaagctaatgcgatcaaacacttgtcatacttggaagcgtggtctgccaacgacccatactacaacaaggatactaagggggcacaactgccgattgataatgcccttcgtaatgctcttaccaaccttttgatgcgtgataaaaatacacgtatgcagcttggggacatgactgcttttatgaatagtagtttgaatccacgtggtgctaacgataagaacggtgaacgtatggctaactatattttcacccgtgcccacgatactgaagcgcaaaccattatccaacgtatcatccgtgatcgtatcaacccaaatctgtttggttacaatttcacccgtgatgaaatcaagaaggctttcgagatttacaatgcggatatcaatacagctcacaagacttatgcgtcatacaacttgccatctgtctatgccctcatgttgaccaacaaggactctgtgacacgtgtttattatggagacctctaccgtgaagacggtcactacatggccaagaagacgccttactttgatgccatcgatacccttttgcgtgcccgtatcaagtatgtggccggtggtcaagacatggaagtgaagaaagtcggaaatgatggacttttgacttctgttcgttatggtaagggtgccaataacagcactgattggggaactactgaaacccgtacgcaagggatgggtgtcattttgaccaataactacgatttccgcttgggtagcaatgaaactgtaacgatgaatatgggtagagcccaccgtaatcagctttaccgtccattgcttttgacgactaaggatggtctagcaacctacctcaacgattctgatgtaccttcaaaccttcttaaacgtaccgactggaatgggaatttgaccttcaatgccaacgatgtttttggtgtggaaaatgtgcaagtatcaggttacctcggtgtctgggtaccagtcggggctaaggctaaccaagacgcacgtacacagccaagtaaccgtgccaatagtgatggtcaagtttacaagtcttcagcagcccttgattcgcaagttatgtatgaagccttctcaaacttccaagcgtttgcggacgatcagccagaactctacatgaaccgtgtcttggctaagaacactgacttgctcaaagcgtggggtgttacatctgttggacttccaccacagtacgtttcaagtaaggatggtaccttcctcgattcaacgattgacaatggttatgcctttgatgaccgttatgacatggccttgagtcaaaataataaatatggctcacttgaggacctccttaacgtccttcgtgccctccacaaagatggtattcaagccattgctgactgggtgccagaccaaatctataaccttccaggtaaggaagtggtgaatgccacacgtgttaacggctacggttatcaccaacaaggttatcaaattgtggaccaagcctatgtggcaaatacccgtacagatggtacagactatcaaggtagatacggtggtgccttccttgatgagctgaaagctaagtacccatctattttcaaccgtgtgcaaatctcaaatggtaagcagttgcctacgaatgaaaagattacaaaatggtctgctaagtacttcaacggaaccaacatccttggacgaggcatcaattatgtccttcgtgatgacaagaccaaccagtactttaatacttcagccaacggccaactcttgccaacaccacttcgtgacacaggtgccatcacaagcactcaagtcttccaacgtcgtggacaagatgtttacttccttcgtgataatcaagttatcaagaatgaatttgttcaagacggtaacggtaactggtattacttcggtgctgacggtaagatgaccaagggtgcccaaaacatcaatagcaaggattactatttctttgataatggtgttcaattgcgtaacgctcttcgtcgtgcaagcaacggctatacttactattacggtttagatggtgccatgattaagaatgcctttgttgattttgatgacaaacatcagcaagttcgtgcctttacgactcaaggaacaatggtagtgggtaaccttcattggagtggtcaccatttctattttgaccgtgaaactggtattcaggccaaggatcgcattgtccgtaccgatgatggcaagttgcattactatgttgcccaaacaggtgacatgggacgcaatgtctttgcgacagatagcaggacaggcaaacgttattactttgacgctgatggtaacactgtgactggttcacgtgtcattgacggtaagacttattactttaaccaagatggtagtgtcggtacggcctacagcaatcgtgcagattctattatctttgaaaatggtaaggctcgctatatcaccccagcaggtgagatcggacgtagcatctttgtctacaacccagcaacaaaggcatggaactactttgataaagaaggtaaccgtgtcacaggtcgtcagtacattgacggtaacctctattacttcaaggaagatggtagtcaggttaagggcgctattgttgaagaaaatggcatcaagtattactatgagccgggctcaggtattctcgcaagcggacgctacctccaagtaggcgatgaccagtggatttactttaaacatgacggttcacttgctatcggccaagttcgtgcagacggtggctacctcaaatactttgataaaaatggtatccaagtcaaggggcaaactatcgtcgaagatggtcacacttattactatgatgctgatagtggggctcttgtaacaagtagctttgctgagattgcaccaaaccaatgggcttacttcaacacggaaggccaagccctcaaaggcaagtggacgatcaatggcaaggaatactactttgaccaaaatggtatccaatacaagggcaaagctgttaaggtcggtagtcgttacaagtactatgacgaaaacgacggtcaacctgtaaccaaccgcttcgctcaaatcgagcctaacgtctgggcttatttcggagcagacggatatgccgtaacgggcgaacaagttatcaatggccaacacctttactttgaccaatcaggtcgccaagttaaaggggcctacgtcacagtcaacggccaacgccgttactatgatgctaacactggcgaatatatcccaggaagataa

SEQ ID NO: 87 - DNA, 4179 bp, Streptococcus salivarius K12
attaacggcaaacaatactatgtcaatagtgacggtagtgtgcgtaagaacttcgtctttgagcaagatgggaagtcatattactttgatgctgaaacaggggctcttgcgaccaagtcacaggatgaattttcaacagaacctatcaaggcagctgtggatttttcatctggaaatcagctctacaaaaacgataacaaatctttggaccaactcgacaccttcatcacagcagatgcttggtaccgtccaaagagtattctcaaggatggtaagacttggacagcttcaactgaagcggacaaacgtccactcttgatggtttggtggcctgacaaatcgactcaggttaactacctaaactacatgcaaaatcaaggtcttggtgcgggatcattttcaactaactctagccaagaaagtctaaatctagctgctaaagcggttcagactaagattgaagaacgtattgcgcgtgaaggcaatacaaactggttgcgtacaagtatcgaccagttcatcaagactcagccaggttggaatagtagcactgaaaatagttcctacgaccacttgcaaggtggacagttgctctttaacaacagtaagggtgatactggtaaccgtactagctacgccaactctgattatcgtttgcttaaccgcacaccgactaatcagacgggtacacgtaagtacttcaaggacaattctatcggtggtcttgagttcttgcttgccaacgatattgataactcaaacccagctgttcaggcggagcaacttaactggctccacttcatgatgaatatcggaagtatcatggcaaatgacccaactgctaactttgatggtttgcgtgtcgatgccttggataatgtggatgctgaccttctccaaatcgcttctgattacttcaaagcagcctatggtgttgacaagtctgaagccaatgcgatcaaacacttgtcatacttggaagcatggtctgccaacgacccatattacaacaaggacaataagggggcacaactgccgattgataatgcccttcgtaatgctcttaccaaccttttgatgcgtgataaaaatacacgtatgcagcttggagacatgactgcttttatgaatagtagtttgaatccacgaggtgctaacgataagaacggtgaacgtatggcaaactatattttcacccgtgcccacgatacggaagcgcaaaccattatccaacgtatcatccgtgatcgtatcaacccaaatctgtttggttacaatttcacccgtgatgaaatcaagaaggccttcgagatttacaatgcggatatcaatacagctcacaagacttatgcatcttacaacttgccatctgtctatgccctcatgttgaccaacaaggactctgtaacacgtgtttattacggtgacctctaccgtgaggatggtcactacatggcgaaaaagacgccttactttgatgctatcgacaccctcttgcgtgcccgtatcaagtatgtagctggtggtcaagacatggaagtgaagaaagtcggaaatgacggcctcttgacatcagttcgttatggtaaaggtgccaataacagaactgattggggaactgctgaaacccgtacgcaagggatgggtgtcatcatgaccaacaactatgatttccgattgggtagcaatgaaactgtaacgatgaatatgggtagagctcaccgcaatcaactttatcgcccattgcttttgacaacaaaagatggtatagcaacctacctcaacgattctgatgtgcctaaaaaccttcttaaacgtaccgactggaatgggaacttgaccttcaatgccaatgatatttttggtgtggaaaatgtgcaagtatcaggttacctcggtgtctgggtaccagtcggggctaaggctaaccaagacgcacgtacacagccaagtaatcgtgccaatagcgatggtcaagtttacaagtcttcagcagcccttgattcgcaagtcatgtatgaagccttctcaaacttccaagcatttgcggacgatcagccagaactttacatgaaccgtgtcttggctaagcacactgacttgctcaaagcatggggtgttacgtctgttggacttccaccacagtacgtttcaagtaaggatggtaccttccttgattcaacaattgacaatggttatgcctttgatgaccgttatgacatggccttgagtcaaaataacaagtatggctcacttgaggacctccttaatgtccttcgtgccctccacaaagatggtattcaagccattgctgactgggtgccagaccaaatttataaccttccaggaaaagaagtagttaatgcgacacgtgttaacggctacggttatcaccaacaaggttatcagattgtggaccaagcctatgtggcaaatacccgtacagatggtacagactatcaaggtaaatatggtggtgccttccttgatgagcttaaagctaagtacccatctattttcaaccgtgtgcaaatctcaaatggtaagcaattgcctacgaatgaaaagattaccaaatggtctgctaagtacttcaacggaactaacatccttggacgaggcatcaactttgtccttcgtgatgacaagaccaaccagtactttaatacttcagccaacggccaactcttgccaacaccacttcgtgacacaggtgtcattacaagcactcaagtcttccaacgtcgtggacaagatgtttacttccttcgtgataaccaagccgttaagaatgaatttgttcaagacggtaacggtaactggtattacttcggtgctgacggtaagatgaccaagggtgcccaaaacatcaatagcaaggattactatttctttgataatggtgttcaattgcgtaacgcccttcgtcgtgctaacaacggctatacttactattacggtatagacggtgccatggttaagaatgccttcgttgattttgatgataaacgtaagcaagtccgtgcctttacaacacaaggaaccatggtagtgggtaaccttcattggagtggtcaccatttctactttgaccgtgaaactggtcttcaggctaaggatcggattgtccgtactgatgatggcaaattgcattactatgctgcccaaacaggtgatatgggacgcaatgtctttgcgactgatagcagcacaggcaagcgttattacttcgatgctgatggtaacactgtgacaggttcacgtgtcattgacggtaagacttattactttaaccaagatggtagtgtcggtacggcctacagcaatcgtgcagattctattatctttgaaaatggtaaggctcgctacatcaccccagcaggcgaaatcggacgtagcatctttgtctataacccagcaactaaggcctggaactactttgataaagaaggtaaccgtgtgacaggtcgtcaatacattgatggtcacctctattacttcaaggaagatggtagccaagctaagggtgaaattattgaagaaaatggcatcaagtattactatgagccagaatcaggtattcttgcttcaggacgctacctccaagttggtgatgaccagtggatgtacttcaaacaagacggttcactggctatcggccaagttcgtgctgatcatggataccttaagtactttgataaaaatggtatccaagtcaagggtaaaaccattgttgaagatggtaagacttattactatgatgcccacagtggagctcttgtaacaagcagctttgctgagattgcaccaaaccaatggtcttacttcaatactgatggacaagcccttaaaggcaagtggactatcaatggcaaggaatactactttgaccaaaatggtatccaatacaagggcaaagccgttaaggtcggtagtcgttacaagtactatgacgaaaacgatggtcaacctgtaaccaaccgcttcgctcaaatcgagcctaacgtctgggcttatttcggagctgatggctatgccgtaacaggcgaacaagtcatcaatggacaacacctttactttgaccaatcaggtcgccaagttaaaggtgcctacgtcacagtcaacggccaacgccgttactatgatgctaacactggcgaatatatcccaggaagataa

SEQ ID NO: 88 - protein, 1392 aa, Streptococcus salivarius K12
INGKQYYVNSDGSVRKNFVFEQDGKSYYFDAETGALATKSQDEFSTEPIKAAVDFSSGNQLYKNDNKSLDQLDTFITADAWYRPKSILKDGKTWTASTEADKRPLLMVWWPDKSTQVNYLNYMQNQGLGAGSFSTNSSQESLNLAAKAVQTKIEERIAREGNTNWLRTSIDQFIKTQPGWNSSTENSSYDHLQGGQLLFNNSKGDTGNRTSYANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDNKGAQLPIDNALRNALTNLLMRDKNTRMQLGDMTAFMNSSLNPRGANDKNGERMANYIFTRAHDTEAQTIIQRIIRDRINPNLFGYNFTRDEIKKAFEIYNADINTAHKTYASYNLPSVYALMLTNKDSVTRVYYGDLYREDGHYMAKKTPYFDAIDTLLRARIKYVAGGQDMEVKKVGNDGLLTSVRYGKGANNRTDWGTAETRTQGMGVIMTNNYDFRLGSNETVTMNMGRAHRNQLYRPLLLTTKDGIATYLNDSDVPKNLLKRTDWNGNLTFNANDIFGVENVQVSGYLGVWVPVGAKANQDARTQPSNRANSDGQVYKSSAALDSQVMYEAFSNFQAFADDQPELYMNRVLAKHTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINFVLRDDKTNQYFNTSANGQLLPTPLRDTGVITSTQVFQRRGQDVYFLRDNQAVKNEFVQDGNGNWYYFGADGKMTKGAQNINSKDYYFFDNGVQLRNALRRANNGYTYYYGIDGAMVKNAFVDFDDKRKQVRAFTTQGTMVVGNLHWSGHHFYFDRETGLQAKDRIVRTDDGKLHYYAAQTGDMGRNVFATDSSTGKRYYFDADGNTVTGSRVIDGKTYYFNQDGSVGTAYSNRADSIIFENGKARYITPAGEIGRSIFVYNPATKAWNYFDKEGNRVTGRQYIDGHLYYFKEDGSQAKGEIIEENGIKYYYEPESGILASGRYLQVGDDQWMYFKQDGSLAIGQVRADHGYLKYFDKNGIQVKGKTIVEDGKTYYYDAHSGALVTSSFAEIAPNQWSYFNTDGQALKGKWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYIPGR

SEQ ID NO: 89 - DNA, 4179 bp, Streptococcus salivarius PS4
atcaatggcaaacaatactatgtcaatagtgacggtagtgtgcgtaagaactttgtctttgagcaagatggtaagtcatattactttgatgctgaaacaggggctcttgcgaccaagtcacaggatgaattttcaacagaacctatcaaggcagctgtggatttttcatctggaaatcagctctacaaaaacgataacaaatctttggaccaactcgacaccttcatcactgcggatgcttggtaccgtccaaagagtattctcaaggatgggaagacttggacagcttcaactgaagcggacaaacgtcctatcttgatggtttggtggcctgacaaatcgactcaggttaactaccttaactacatgcaaaatcaaggtcttggtgcaggatcattttcaaccaactctagtcaggaaagtctaaatcaagctgctaagatggttcagactaagattgaagaacgtatcgcgcgtgaaggcaataccaactggttgcgtacaagtattgatcagtttatcaagactcagccaggttggaatagcagtactgaaaatagttcatacgaccacttgcaaggcggtcaattgctctttaacaacagtaagggtgatacaggaaaccgtactagctacgccaactctgattatcgtttgcttaaccgcacaccgacgaaccagagtggaacacgtaagtatttcaaggacaattctatcggtggtcttgagttcttgcttgccaacgatattgataactcaaacccagctgtccaggcggagcaacttaactggctccacttcatgatgaatatcggaagcatcatggcaaatgacccaacagccaactttgacggtttgcgtgtcgatgctttggacaatgtggatgctgaccttctccaaatcgcctcagattacttcaaagcagcctatggtgttgacaagtctgaagccaatgcgatcaaacacttgtcatacttggaagcatggtctgctaacgacccatactacaacaaggatactaagggggcacaactgccgattgataatgcccttcgtaatgcccttaccaaccttttgatgcgtgataaaaatacacgtatgcagcttggggacatgacggccttcatcaacagtagtttgaatccacgtggtgctaacgataagaacggtgagcgcatggcaaactatattttcacccgtgcccacgatactgaagcgcaaaccattatccaacgtatcatccgtgatcgtatcaacccaaatctgtttggttacaatttcactcgtgatgaaatcaagaaggccttcgagatttacaatgcggatattgataaggctcataaaacttatgcgtcttacaacttgccatctgtctatgctctcatgttgaccaacaaggactctgtgacacgtgtttattatggagacctctatcgtgaggatggtcactacatggcccaaaagacgccttactttgatgctattgacacccttttgcgtgctcgtatcaagtatgtggccggtggtcaagacatggaagtgaagaaagtcggaaatgacggacttttgacttctgttcgttatggtaaaggtgccaataacagaactgattggggaactgctgaaacccgtacgcaagggatgggtgtcatcatgaccaacaactatgatttccgattgggtagcaatgaaactgtaacgatgaatatgggtagagcccaccgcaatcagctttatcgcccattgcttttgacaacaaaagacggtatagcaacctacctcaacgattctgatgtgcctaaaaaccttcttaaacgtacagatggctatgggaacttgaccttcaatgccaatgatgtttttggtgtggaaaatgtgcaagtatcaggttacctcggtgtttgggtaccagttggagctacgcctaaccaggacgcacgtacacagccaagtaaccgtgccaacagtgatggtcaagtttacaagtcttcagcagcccttgattcgcaagtcatgtatgaagccttctcaaacttccaagcctttgcggacgatcagccagaactctacatgaaccgtgtcttagctaagaacactgacttgctcaaagcatggggtgttacgtctgttggacttccaccacagtacgtttcaagtaaagacggtaccttccttgattcaacgattgacaatggttatgcctttgatgaccgttatgacatggccttgagtcaaaataataaatacggatcacttgaggaccttcttaacgtccttcgtgccctccacaaagatggtatccaagctatcgctgactgggtgccagaccaaatctataaccttccaggaaaagaagttgtgaatgcgacacgtgttaacggctacggttatcaccaacaaggttatcaaattgtggaccaagcctatgtggcaaatacccgtacagatggtacagactatcaaggtaagtacggtggtgccttccttgatgagctaaaagctaagtacccatctattttcaaccgtgtgcaaatctcaaatggtaaacagttgcctacgaatgaaaagattaccaaatggtctgctaagtacttcaacggaaccaacatccttggacgaggcatcaactttgtccttcgtgatgacaagacaaaccagtactttaatacttcagccaacggccaactcttgccaacaccacttcgtgataatggtgccatcacaagcactcaagtcttccaacgtcgtggacaagatgtttacttccttcgtgataatcaagtcatcaagaatgaatttgttcaagacggtgacggcaactggtactacttcggtgctgatggtaagatgactaagggtattcaaaccatcaatagcaaggattactatttctttgacaatggtgttcaattgcgtaatgcccttcgtcgtgccaacaacggttatacttactattacggtatagacggtgccatgattaagaatgccttcgtcgattttgatgacaaacatcagcaagttcgtgcctttacgactcaaggaaccatggtagtgggtaaccttcattggagtggtcaccatttctactttgaccgtgaaacgggtatccaggccaaggatcgtattgttcgtacagatgatggcaaattgcattattatgttgcccaaacaggtgacatgggacgcaatgtctttgcgacagacagcagcacaggtaaacgttattacttcgatgctgatggtaacactgtgacaggttcacgtgtcattgacggtaagacctattactttaaccaagatggtagtgtcggtacggcctacagcaaccgagcggattctattatctttgaaaatggtaaggctcgctacatcaccccagcaggtgaaatcggacgcagtatctttgtctataacccagcaactaaggcttggaactactttgataaagaaggtaaccgtgttactggacgtcagtacattgacggtaacctctattacttcaaggaagatggtagtcaggttaagggcgctattgtcgaagaaaatggcatcaaatattactatgagccagattcaggtatccttgcgagaaaccgttacctccaagtaggtgacgaccagtggatttactttaaacatgatggttcactggctatcgggcaggttcgtgcagacggtggctacctcaaatactttgataaaaatggtatccaagtcaagggtcaaactatcatcgaagatggtcacacttattactatgatgctaatagtggtgccctcgtcacaagtagctttgctgagattgcaccaaaccaatggtcttatttcaatactgaaggccaagcccttaaaggcaattggactatcaatggcaaggaatactactttgaccaaaatggtatccagtacaagggcaaggccgttaaggtcggcagtcgttacaagtactatgacgaaaacgatggacaacctgtaaccaaccgcttcgctcaaatcgagcctaacgtctgggcttactttggagcagatggatatgccgtgacaggggaacaagtcatcaatggacaacacctttactttgaccaatcaggtcgccaagttaaaggtgcctacgtcacagtcaacggtcaacgtcgttactacgatgccaacactggcgaatatgtcccaggaagataa

SEQ ID NO: 90 - protein, 1392 aa, Streptococcus salivarius PS4
INGKQYYVNSDGSVRKNFVFEQDGKSYYFDAETGALATKSQDEFSTEPIKAAVDFSSGNQLYKNDNKSLDQLDTFITADAWYRPKSILKDGKTWTASTEADKRPILMVWWPDKSTQVNYLNYMQNQGLGAGSFSTNSSQESLNQAAKMVQTKIEERIAREGNTNWLRTSIDQFIKTQPGWNSSTENSSYDHLQGGQLLFNNSKGDTGNRTSYANSDYRLLNRTPTNQSGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNADIDKAHKTYASYNLPSVYALMLTNKDSVTRVYYGDLYREDGHYMAQKTPYFDAIDTLLRARIKYVAGGQDMEVKKVGNDGLLTSVRYGKGANNRTDWGTAETRTQGMGVIMTNNYDFRLGSNETVTMNMGRAHRNQLYRPLLLTTKDGIATYLNDSDVPKNLLKRTDGYGNLTFNANDVFGVENVQVSGYLGVWVPVGATPNQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINFVLRDDKTNQYFNTSANGQLLPTPLRDNGAITSTQVFQRRGQDVYFLRDNQVIKNEFVQDGDGNWYYFGADGKMTKGIQTINSKDYYFFDNGVQLRNALRRANNGYTYYYGIDGAMIKNAFVDFDDKHQQVRAFTTQGTMVVGNLHWSGHHFYFDRETGIQAKDRIVRTDDGKLHYYVAQTGDMGRNVFATDSSTGKRYYFDADGNTVTGSRVIDGKTYYFNQDGSVGTAYSNRADSIIFENGKARYITPAGEIGRSIFVYNPATKAWNYFDKEGNRVTGRQYIDGNLYYFKEDGSQVKGAIVEENGIKYYYEPDSGILARNRYLQVGDDQWIYFKHDGSLAIGQVRADGGYLKYFDKNGIQVKGQTIIEDGHTYYYDANSGALVTSSFAEIAPNQWSYFNTEGQALKGNWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYVPGR

SEQ ID NO: 91 - DNA, 4179 bp, Streptococcus sp. HSISS3
attaacggcaaacaatactatgtcaatagtgacggtagtgtgcgtaagaactttgtctttgagcaagatggtaagtcatattactttgatgctgaaacaggggctcttgcgaccaagtcacaggatgaattttcaacagaacctatcaaggcagctgtggatttttcatctggaaatcagctctacaaaaacgataacaagtctttggaccaactcgacaccttcatcacagcggatgcctggtaccgtccaaagagtattctcaaggatggtaagacttggacagcttcaactgaagcggacaaacggcctctcttgatggtttggtggcctgataaatcgactcaggttaactaccttaactacatgcaaaatcaaggtcttggtgcaggttcattttcaaccaactctagccaggaaagtctaaatctagctgctaaagcggttcagactaagattgaagagcgtattgcgcgtgaaggcaataccaactggttgcatacaagtattgatcagtttatcaagactcagccaggttggaatagtagcactgaaaatagttcatacgaccacttgcaaggtggacagttgctctttaacaacagtaagggtgatactggtaatcgtaccagctacgccaactctgactatcgtctacttaaccgcacacctactaaccagacgggtacacgtaagtacttcaaggacaattctatcggtggtcttgagttcttgcttgccaacgatattgataactcaaacccagctgttcaggcggagcaacttaactggctccactttatgatgaatatcggaagcatcatggcaaacgatccaacagccaactttgacggtttgcgtgtcgatgctttggacaatgtggatgctgaccttctccaaatcgcttcagattacttcaaagcagcctatggtgttgacaagtctgaagccaatgcgatcaaacacttgtcatacttggaagcatggtctgccaacgacccatattacaacaaggacaataagggggcacaactgccgattgataatgcccttcgtaatgctcttaccaaccttttgatgcgtgataaaaatacacgtatgcaacttggggacatgactgcttttatgaatagtagtttgaatccacgtggtgctaatgataagaacggtgaacgtatggcaaactatattttcacccgtggacacgatactgaagcgcaaaccattatccaacgtatcattcgtgatcgtatcaatccaaatctgtttggttacaatttcacccgtgatgaaattaagaaggccttcgagatttacaatgaggatattgataaggctcataaaacttatgcgtcttacaacttgccatctgtctatgccctcatgttgaccaacaaggactctgtaacacgtgtttattacggtgacctctaccgtgaggatggtcactacatggcgaaaaagacgccttactttgatgctatcgacaccctcttgcgtgcccgtatcaagtatgtagctggtggtcaagacatggaagtgaagaaagtcggaaatgacggcctcttgacatcagttcgttatggtaaaggtgccaataacagaactgattggggaactgctgaaacccgtacgcaagggatgggtgtcatcatgaccaacaactatgatttccgattgggtagcaatgaaactgtaacgatgaatatgggtagagcccaccgtaatcagctttaccgtccattgcttttgacgactaaggatggtctagcaacctacctcaacgattctgatgtaccttcaaaccttcttaaacgtaccgactggaatgggaacttgaccttcaatgccaacgatgtttttggtgtggaaaatgtgcaagtatcaggttacctcggtgtctgggtaccagtcggggctaaggctaaccaagacgcacgtacacagccaagtaaccgtgccaatagcgatggacaagtttacaagtcttcagcagcccttgattcgcaagtcatgtatgaagccttctcaaacttccaagcatttgcggacgatcagccagaactctacatgaaccgtgtcttggctaagcacactgacttgctcaaagcatggggtgttacgtctgttggacttccaccacagtacgtttcaagtaaagatggtaccttccttgattcaacaattgacaatggttatgcctttgatgaccgttatgacatggccttgagtcaaaataacaagtatggctcacttgaggacctccttaatgttcttcgtgccctccacaaagatggtattcaagccattgctgactgggtgccagaccaaatttataaccttccaggaaaagaagtagttaatgccacacgtgttaacggctacggttatcaccaacaaggttatcaaattgtggaccaagcctatgtggcaaatacccgtacagatggtacagactatcaaggtaaatatggtggtgccttccttgatgagcttaaagctaagtacccatctattttcaaccgtgtgcaaatctcaaatggtaagcagttgcctacgaatgaaaagattaccaaatggtctgctaagtacttcaatggaaccaatatccttggacgaggtatcaactatgtccttcgtgatgacaagaccaaccagtactttaatacctcagccaacggccaactcttgccaacaccacttcgtgacacaggtgccatcacaagcactcaagtcttccaacgtcgtggacaagacgtttacttccttcgtgataaccaaaccgttaagaatgaatttgttcaagatggtaacggtaactggtattacttcggtggtgacggtaagatgaccaagggtgctcgaaacatcaataacaaggattactatttctttgacaatggtatccaattgcgtaacgcccttcgtcgtgcttcaaacggctatacctactattacggtctggacggtgccatggttaagaatgccttcgttgattttgatgacaaacataagcaggttcgtgcctttacgactcaaggaacaatggtagtaggtaaccttcattggagtggacaccatttctactttgaccgtgaaactggtattcaggctaaggatcgcattgtccgtacagatgatggcaaattgcattactatgttgctgaaactggtgatatgggacgtaacgtctttgcgacagacagcagcacaggtaaacgttattactttgacgctgacggtaatactgtgactggttcacgtgtcattgatggtaagacttattactttaaccaagatggtagcgtcggtacggcctacagcaatcgtgcagattctattatctttgaaaatggtaaggctcgctacatcacaccagcaggcgaaatcggacgcagcatctttgtctataatccagcaactaaggcttggaattactttgataaagaaggtaaccgtgttacaggacgtcaatacattgatggtcacctttattacttcaaggaagatggtagccaagctaagggtgaaattatcgaagaaaatggcatcaaatattattatgagccagaatcaggtattcttgcttcaggacgctatctccaagtaggtgatgaccagtggatgtacttcaaacacgatggttcactggctatcggccaagttcgtgctgatcatggataccttaagtactttgataaaaatggtatccaagttaaggggaaaactgttgtcgaagatggtaagacttattactatgatgcccacagtggagctcttgtcacaagcagctttgctgagattgcaccaaaccaatggtcttacttcaatactgatggacaagcccttaaaggcaagtggactatcaatggcaaggaatactactttgacgaaaatggtatccaatacaaaggcaaggccattaaggtcggcagtcgttacaagtactatgacgaaaacgacggtcaacctgtaaccaaccgctttgctcaaatcgagcctaacgtctgggcttacttcggagcagatggttatgccgtaacaggcgaacaagtcatcaatggacaacacctttactttgatcaatcaggtcgccaagttaaaggtgcctacgtcacagttaacggtcaacgccgttattacgatgctaacactggcgaatatgtcccagaaagataa

SEQ ID NO: 92 - protein, 1392 aa, Streptococcus sp. HSISS3
INGKQYYVNSDGSVRKNFVFEQDGKSYYFDAETGALATKSQDEFSTEPIKAAVDFSSGNQLYKNDNKSLDQLDTFITADAWYRPKSILKDGKTWTASTEADKRPLLMVWWPDKSTQVNYLNYMQNQGLGAGSFSTNSSQESLNLAAKAVQTKIEERIAREGNTNWLHTSIDQFIKTQPGWNSSTENSSYDHLQGGQLLFNNSKGDTGNRTSYANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDNKGAQLPIDNALRNALTNLLMRDKNTRMQLGDMTAFMNSSLNPRGANDKNGERMANYIFTRGHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDWGTAETRTQGMGVIMTNNYDFRLGSNETVTMNMGRAHRNQLYRPLLLTTKDGLATYLNDSDVPSNLLKRTDWNGNLTFNANDVFGVENVQVSGYLGVWVPVGAKANQDARTQPSNRANSDGQVYKSSAALDSQVMYEAFSNFQAFADDQPELYMNRVLAKHTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQTVKNEFVQDGNGNWYYFGGDGKMTKGARNINNKDYYFFDNGIQLRNALRRASNGYTYYYGLDGAMVKNAFVDFDDKHKQVRAFTTQGTMVVGNLHWSGHHFYFDRETGIQAKDRIVRTDDGKLHYYVAETGDMGRNVFATDSSTGKRYYFDADGNTVTGSRVIDGKTYYFNQDGSVGTAYSNRADSIIFENGKARYITPAGEIGRSIFVYNPATKAWNYFDKEGNRVTGRQYIDGHLYYFKEDGSQAKGEIIEENGIKYYYEPESGILASGRYLQVGDDQWMYFKHDGSLAIGQVRADHGYLKYFDKNGIQVKGKTVVEDGKTYYYDAHSGALVTSSFAEIAPNQWSYFNTDGQALKGKWTINGKEYYFDENGIQYKGKAIKVGSRYKYYDENDGQPVTNRFAQIEPNVWAYFGADGYAVTGEQVINGQHLYFDQSGRQVKGAYVTVNGQRRYYDANTGEYVPER

SEQ ID NO: 93 - DNA, 4179 bp, Streptococcus sp. HSISS2
attaacggcaaacaatactatgtcaatagtgacggtagtgtgcgtaagaactttgtctttgagcaagatggtaagtcttattactttgatgctgaaacaggggctcttgcgactaagtcacaggatgaattttcaacagaaccaatcaaggcaaccgtcgatttttcatctggaaaccagctctacaaaaacgatgataaatcgttggaccagctcgataccttcatcacagcggatgcttggtaccgtccaaagagcattctcaaggatggtaagacttggacggcttcaactgaggctgacaaacgtccactcttgatggtttggtggcctgacaagtcaactcaggttaactaccttaactacatgcaaaatcaaggtcttggtgcaggctcattttcaaccaactctagccaggaaagtctggaccaagctgctaaagcggttcagactaagattgaagaacgtatcgctcgtgaaggcaataccaactggttgcgtacaagtattgatcagttcatcaagactcagccaggttggaatagtagcactgaaaatagttcatacgaccacttgcaaggcggacagttgctctttaacaatagtaagggtgatactggtaaccgtactagctacgccaactctgattatcgtttgcttaaccgcacaccgacaaaccagagtgggacacgtaagtacttcaaggacaattctatcggtggtcttgagttcttgcttgccaacgatattgataactcaaacccagctgttcaggcggagcaacttaactggctccactttatgatgaatatcggaagcatcatggcaaacgacccaacagccaactttgacggtttgcgtgtcgatgccttggacaatgtggatgctgaccttctccaaatcgcttcagattacttcaaagcagcctatggtgttgacaagtctgaagccaatgcgatcaaacacttgtcatacttggaagcctggtctgccaacgacccatattacaacaaggacactaagggggcacaactgccgattgataatgcccttcgtaatgctcttaccaaccttttgatgcgtgataaaaatacacgtatgcagcttggggacatgactgccttcatcaacagtagtttgaatccacgtggtgccaacgataaaaatggtgagcgtatggctaactatattttcacccgtgcccacgatactgaagcccaaaccattatccaacgtatcatccgtgatcgtatcaatccaaatctgtttggctacaatttcacccgtgatgaaatcaagaaagccttcgagatttacaatgcggatatcaatacagctcacaagacttatgcgtcatacaacttgccatctgtctatgccctcatgttgaccaacaaggactctataacacgtgtttattacggtgacctctaccgtgaggatggtcactacatggcaaagaagacgccttactttgatgccatcgacaccctcttgcgtgcccgtatcaagtatgtagctggtggtcaagacatggaagtgaagaaagtcggaaatgacggcctcttgacatcagttcgttatgggaaaggtgccaataacagaactgattggggaactgctgaaacccgtacgcaagggatgggtgtcatcatgaccaataactatgatttccgattgggtagcaatgaaactgtaacgatgaatatgggtagagcccaccgtaatcagctttaccgtccattgcttttgacgactaaggatggtatagcaacctacctcaacgattctgatgtaccttcaaaccttcttaaacgtaccgactggaatgggaacttgaccttcaataccaatgatatttttggtgtggaaaatgtgcaagtatcaggttacctcggtgtctgggtaccagtcggggctaaggctaaccaagacgcacgtacacagccaagtaaccgtgccaatagcgatggtcaagtttacaagtcttcagcagcccttgattcgcaagtcatgtatgaagcattctcaaacttccaagcatttgcggacgatcagccagaactctacatgaaccgtgtcttggctaagaacactgacttgctcaaagcatggggtgttacatctgttggacttccaccacagtacgtttcaagtaaagatggtaccttcctcgattcaacgattgacaatggttatgcctttgatgaccgttatgacatggccttgagtcaaaataacaagtatggctcacttgaagacctccttaacgtccttcgtgccctccacaaagatggtattcaggccattgctgactgggtgccagaccaaatctataaccttccaggtaaggaagtggtgaatgccacgcgtgttaacggctacggttatcatcaacaaggttatcaaattgtggaccaagcctatgtggcaaatacccgtacagatggcacagactatcaaggcaagtacggtggtaccttccttgatgagcttaaagctaagtacccatctattttcaaccgtgtgcaaatttcaaatggtaagcagttgcctacgaatgaaaagatcaccaaatggtctgctaagtacttcaacggaaccaacatccttggacgaggcatcaattatgttcttcgtgatgacaagaccaatcagtactttaatacttcagccaacggccaactcttgccaacaccacttcgtgacacgggtgccatcacaagcactcaagtcttccaacgtcgtggacaagatgtttacttccttcgtgataatcaagttatcaaaaatgaatttgttcaagacggtgacggcaactggtattacttcggtgctgacggtaagatgactaagggtattcaaactatcaatagcaaggattactatttctttgacaatggtatccaattgcgtaacgctcttcgtcgtgcttcaaacggttatacttactattacggtctggacggtgccatgattaagaatgcctttgttgattttgatgacaaacatcagcaagttcgtgcctttacgactcaaggaacaatggtagtgggtaaccttcattggagtggtcaccatttctattttgaccgtgaaacgggtattcaggccaaggatcgcattgtccgtaccgatgatggcaagttgcattactatgctgcccaaacaggtgacatgggacgcaatgtctttgcgacagatagcaggacaggcaaacgttattactttgacgctgatggtaacactgtgactggttcacgtgtcattgacggtaagacttattactttaaccaagatggtagtgtcggtacggcctacagcaatcgtgcagattctattatctttgaaaatggtaaggctcgctacatcacaccagcaggcgaaatcggacgcagcatctttgtctataatccagcaactaaggcttggaattactttgataaagaaggtaaccgtgttacaggacgtcaatacattgatggtcacctttattacttcaaggaagatggtagccaagctaagggtgaaattatcgaagaaaatggcatcaaatattattatgagccagaatcaggtattcttgcttcaggacgctacctccaagttggtgatgaccagtggatgtacttcaaacaagacggttcactggctatcggccaagttcgtgctgatcatggataccttaagtactttgataaaaatggtatccaagttaaggggaaaactgttgtcgaagatggtaagacttattactatgatgcccacagtggagctcttgtcacaagcagctttgctgagattgcaccaaaccaatggtcttacttcaatactgatggacaagcccttaaaggcaagtggactatcaatggcaaggaatactactttgacgaaaatggtatccaatacaaaggcaaggccattaaggtcggcagtcgttacaagtactatgacgaaaacgacggtcaacctgtaaccaaccgctttgctcaaatcgagcctaacgtctgggcttacttcggagcagatggttatgccgtaacaggcgaacaagtcatcaatggacaacacctttactttgatcaatcaggtcgtcaagttaaaggtgcctacgtcacagttaacggtcaacgccgttattacgatgctaacactggcgaatatgtcccagaaagataa

SEQ ID NO: 94 - protein, 1392 aa, Streptococcus sp. HSISS2
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSYANSDYRLLNRTPTNQSGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNADINTAHKTYASYNLPSVYALMLTNKDSITRVYYGDLYREDGHYMAKKTPYFDAIDTLLRARIKYVAGGQDMEVKKVGNDGLLTSVRYGKGANNRTDWGTAETRTQGMGVIMTNNYDFRLGSNETVTMNMGRAHRNQLYRPLLLTTKDGIATYLNDSDVPSNLLKRTDWNGNLTFNTNDIFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGTFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQVIKNEFVQDGDGNWYYFGADGKMTKGIQTINSKDYYFFDNGIQLRNALRRASNGYTYYYGLDGAMIKNAFVDFDDKHQQVRAFTTQGTMVVGNLHWSGHHFYFDRETGIQAKDRIVRTDDGKLHYYAAQTGDMGRNVFATDSRTGKRYYFDADGNTVTGSRVIDGKTYYFNQDGSVGTAYSNRADSIIFENGKARYITPAGEIGRSIFVYNPATKAWNYFDKEGNRVTGRQYIDGHLYYFKEDGSQAKGEIIEENGIKYYYEPESGILASGRYLQVGDDQWMYFKQDGSLAIGQVRADHGYLKYFDKNGIQVKGKTVVEDGKTYYYDAHSGALVTSSFAEIAPNQWSYFNTDGQALKGKWTINGKEYYFDENGIQYKGKAIKVGSRYKYYDENDGQPVTNRFAQIEPNVWAYFGADGYAVTGEQVINGQHLYFDQSGRQVKGAYVTVNGQRRYYDANTGEYVPER

SEQ ID NO: 95 - DNA, 4179 bp, Streptococcus salivarius NU10
attaacggcaaacaatactatgtcaatagtgacggtagtgtgcgtaagaacttcgtctttgagcaagatggtaagtcatattactttgatgccgaaacaggggctcttacgaccaagtcacaggatgaattttcaactaaacctatcaaggcgaccgtagatttttcatctggaaatcagctctacaaaaacgataacaaatctttggaccaactcgacaccttcatcactgcggatgcttggtaccgtccaaagagtattctcaaggatggtaagacttggacagcttcaactgaagcggacaaacgtccactcttgatggtttggtggcctgacaaatcgactcaggttaactacctaaactacatgcaaaatcaaggtcttggtgcgggatcattttcaaccaactctagccaggaaagtctaaatctagctgctaaagcggttcagactaagattgaagagcgtattgcgcgtgaaggcaataccaagtggttgagtacaagtattaatcaatttatcaagactcagccaggttggaatagtagcactgaaaatatttcatacgaccacttgcaaggtggacagttgctctttaacaacagtaagggtgatactggtaaccgtactagctacgccaactctgattatcgtctacttaaccgcacacctactaaccagacgggtacacgtaagtacttcaaggacaattctatcggtggtcttgagttcttgcttgccaacgatattgataactcaaacccagctgttcaggcggagcaacttaactggctccactttatgatgaatatcggaagtatcatggcgaatgacccaactgctaactttgacggtttgcgtgtcgatgccttggacaatgtggatgctgaccttctccaaatcgcttcagattacttcaaagcagcctatggtgttgacaagtccgaagctaatgcgatcaaacacttgtcatacttggaagcgtggtctgccaacgacccatattacaacaaggacaataagggggcacaactgccgattgataatgcccttcgtaatgctcttaccaaccttttgatgcgtgataaaaatacacgtatgcagcttggggacatgactgcttttatgaatagtagtttgaatccacgaggtgctaacgataagaacggtgaacgtatggcgaactatattttcacccgtgcccacgatacggaagcgcaaaccattatccaacgtatcatccgtgatcgtatcaacccaaatctgtttggttacaatttcacacgtgatgaaataaagaaggccttcgagatttacaatgcggatattgataaggctcacaagacttatgcgtcatacaacttgccatctgtctatgccctcatgttgaccaacaaggactctgtaacacgtgtttattatggagacctctaccgtgaggatggtcactacatggcgaaaaagacgccttactttgatgccattgacacccttttgcgtgcccgtatcaagtatgtagctggtggtcaagacatggaagtgaaaaaagtcggaaatgatggacttttgacttctgttcgttatggtaaaggtgccaataacagaactgattggggaactgctgaaacccgtacgcaagggatgggtgtcatcatgaccaacaactatgatttccgattgggtagtaatgaaactgtaacgatgaatatgggtagagctcaccgtaatcagctttatcgcccattacttttgacgactaaggatggtctagcaacctacctcaacgattctgatgtgcctaaaaaccttcttaaacgtaccgactggaatgggaacttgaccttcaacgccaacgatgtttttggtgttgaaaatgtccaagtctcaggttatctcggtgtctgggtaccagtcggagctaaggctaaccaagacgcacgtacacagccaagtaaccgtgccaatagcgatggtcaagtttacaagtcttcagcagcccttgattcgcaagttatgtatgaagccttctcaaacttccaagcatttgcggacaatcagccagaactctacatgaaccgtgtcttggctaagaacactaatttgctcaaagcatggggtgttacgtctgttggacttccaccacagtacgtttcaagtaaggatggtaccttccttgattcaacaattgacaatggttatgcctttgatgaccgttatgacatggccttgagtcaaaataacaagtatggctcacttgaggacctccttaatgtccttcgtgccctccacaaagatggtattcaagccattgctgactgggtgccagaccaaatttataaccttccaggaaaagaagtagttaatgccacacgtgttaacggctacggttatcaccaacaaggttatcaaattgtggaccaagcctatgtggcaaatacccgtacagatggtacagactatcaaggtaaatatggtggtgccttccttgatgagcttaaagctaagtacccatctattttcaaccgtgtgcaaatctcaaatggtaagcagttgcctacgaatgaaaagattaccaaatggtctgctaagtacttcaatggaaccaatatccttggacgaggtatcaactatgtccttcgtgatgacaagaccaaccagtactttaatacctcagccaacggccaactcttgccaacaccacttcgtgacacaggtgccatcacaagcactcaagtcttccaacgtcgtggacaagacgtttacttccttcgtgataaccaaaccgttaagaatgaatttgttcaagatggtaacggtaactggtattacttcggtggtgacggtaagatgaccaagggtgctcgaaacatcaataacaaggattactatttctttgacaatggtatccaattgcgtaacgcccttcgtcgtgcaagcaacggctatacctactattacggtcttgacggtgccatggttaagaatgccttcgttgattttgatgacaaacataagcaggttcgtgcctttacgactcaaggaacaatggtagtaggtaaccttcattggagtggacaccatttctactttgaccgtgaaactggtattcaggctaaggatcgcattgtccgtacagatgatggcaaattgcattactatgttgctgaaactggtgatatgggacgtaacgtctttgcgacagacagcagcacaggtaaacgttattactttgacgctgacggtaatactgtgactggttcacgtgtcattgatggtaagacttattactttaaccaagatggtagcgtcggtacggcctacagcaatcgtgcagattctattatctttgaaaatggtaaggctcgctacatcacaccagcaggcgaaatcggacgcagcatctttgtctataatccagcaactaaggcttggaattactttgataaagaaggtaaccgtgttacaggacgtcaatacattgatggtcacctttattacttcaaggaagatggtagccaagctaagggtgaaattatcgaagaaaatggcatcaaatattattatgagccagaatcaggtattcttgcaagcggacgctatctccaagtaggtgatgaccagtggatgtacttcaaacacgatggttcactggctatcggccaagttcgtgctgatcatggataccttaagtactttgataaaaatggtatccaagttaagggtaaaaccattgtcgaagatggtaagacttattactatgatgcccacagtggagctcttgtaacaagcagctttgctgagattgcaccaaaccaatggtcttacttcaatactgatggacaagcccttaaaggcaagtggactatcaatggcaaggaatactactttgaccaaaatggtatccaatacaagggcaaagctgttaaggtcggtagtcgttacaagtactatgacgaaaacgatggacaacctgtaaccaaccgcttcgctcaaatcgagcctaacgtctgggcttatttcggagctgatggctatgccgtaacaggcgaacaagtcatcaatggacaacacctttactttgaccaatcaggtcgccaagttaaaggcgcctacgtcacagtcaacggccaacgccgttactacgatgctaacactggcgaatatgtcccaggaagataa

SEQ ID NO: 96 - protein, 1392 aa, Streptococcus salivarius NU10
INGKQYYVNSDGSVRKNFVFEQDGKSYYFDAETGALTTKSQDEFSTKPIKATVDFSSGNQLYKNDNKSLDQLDTFITADAWYRPKSILKDGKTWTASTEADKRPLLMVWWPDKSTQVNYLNYMQNQGLGAGSFSTNSSQESLNLAAKAVQTKIEERIAREGNTKWLSTSINQFIKTQPGWNSSTENISYDHLQGGQLLFNNSKGDTGNRTSYANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDNKGAQLPIDNALRNALTNLLMRDKNTRMQLGDMTAFMNSSLNPRGANDKNGERMANYIFTRAHDTEAQTIIQRIIRDRINPNLFGYNFTRDEIKKAFEIYNADIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDWGTAETRTQGMGVIMTNNYDFRLGSNETVTMNMGRAHRNQLYRPLLLTTKDGLATYLNDSDVPKNLLKRTDWNGNLTFNANDVFGVENVQVSGYLGVWVPVGAKANQDARTQPSNRANSDGQVYKSSAALDSQVMYEAFSNFQAFADNQPELYMNRVLAKNTNLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQTVKNEFVQDGNGNWYYFGGDGKMTKGARNINNKDYYFFDNGIQLRNALRRASNGYTYYYGLDGAMVKNAFVDFDDKHKQVRAFTTQGTMVVGNLHWSGHHFYFDRETGIQAKDRIVRTDDGKLHYYVAETGDMGRNVFATDSSTGKRYYFDADGNTVTGSRVIDGKTYYFNQDGSVGTAYSNRADSIIFENGKARYITPAGEIGRSIFVYNPATKAWNYFDKEGNRVTGRQYIDGHLYYFKEDGSQAKGEIIEENGIKYYYEPESGILASGRYLQVGDDQWMYFKHDGSLAIGQVRADHGYLKYFDKNGIQVKGKTIVEDGKTYYYDAHSGALVTSSFAEIAPNQWSYFNTDGQALKGKWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYVPGR

SEQ ID NO: 97 - DNA, 4179 bp, Streptococcus salivarius CCHSS3
attaacggcaaacaatactatgtcaatagtgacggtagtgtacgtaaaaacttcgtttttgagcaagatggtaagtcttattactttgatgctgaaacaggggcacttgcgactaagtctcaggatgaattttcaacagaacctatcaaggcaaccgtagatttttcatctggaaaccagctctacaaaaacgatgacaagtctttggaccaactcgacaccttcatcacagcggatgcttggtaccgtccaaagagcattctcaaggatggtaagacttggacagcttcaactgaagcggacaaacgtcctctattgatggtttggtggcctgacaagtctactcaggtcaactaccttaactacatgcaaaatcaaggtcttggagcagggtcattttcaaccaactctagtcaggaaagtctggaccaagctgctaaagcggttcagactaagattgaagaacgtatcgcgcgtgaaggcaacacaaactggttgcgtacaagtatcaaccagttcatcaagactcagccaggttggaatagtagcactgaaaatagttcctatgaccacttgcaaggtggacagttgctctttaacaacagtaagggtgatactggcaaccgtaccagccacgccaactctgactatcgtttgcttaaccgcacaccgactaaccaaacgggtacacgtaagtacttcaaggacaattctatcggtggtctcgagttcttgcttgccaacgatattgataactcaaatccagcagttcaggcagaacaacttaactggctccactttatgatgaatatcggaagtatcatggcaaatgacccaacagccaactttgacggtttgcgtgtcgatgccttggacaatgtggatgccgacctgctccaaatcgcatcagactactttaaagcagcctatggtgttgacaagtctgaagccaatgccattaaacacttgtcatatttggaagcatggtctgccaacgatccttactacaacaaggacactaagggggcacaacttccgattgacaatgcccttcgtaatgcccttaccaacctcttgatgcgtgataaaaatacacgtatgcagcttggggacatgactgccttcatcaatagtagtttgaacccacgtggtgccaatgataaaaacggtgagcgtatggctaactatattttcacccgtgcccacgatacagaagctcaaacgattattcaacgtatcatccgtgatcgtattaacccaaatttgtttggttataatttcactcgtgatgaaatcaagaaagccttcgagatttacaatcaggatattgataaggctcacaagacttatgcgtcatacaacttgccatctgtctatgctctcatgttgaccaacaaggactctgtaacacgtgtttattacggagacctctaccgtgaaaatggtcactacatggctaagaagacaccgtactttgatgctatcgacaccctcttgcgtgctcgtatcaagtatgtagctggtggtcaagacatggaagttaagaaagtcggaaatgacggactcttgacatctgttcgttatggtaaaggtgccaataatagaactgattggggaacttcggaaacccgtacgcaaggtatgggtgtcatcatgaccaataactatgatttccgattgggtagcaatgaaaccgtaacgatgaacatgggtagagctcaccgtaatcagctttatcgcccattgcttttgacgacaaaggatggtatagcaacctacctcaacgattctgatgtgcctaaaaaccttcttaaacgcaccgactggaacgggaacttgactttcaatgccaacgatgtttttggtgtggaaaatgtccaagtctcaggttacctcggtgtctgggtaccagtcggagctaaggctaatcaagacgcacgtacacagccaagtaaccgtacaaatagtgacggtcaagtttacaagtcttcagcagcccttgattctcaagttatgtatgaagccttctcaaacttccaagcctttgcggacgatcaaccagaactttacatgaaccgtgtcttggctaaaaacactgacttgctcaaagcatggggaatcacgtcagtcggacttccaccacagtacgtttcaagtaaggatggtaccttccttgactcaacaattgataatggttatgcctttgatgaccgttacgatatggccttgagtcaaaataataaatacggatcacttgaggacctccttaacgtccttcgtgccctccacaaagacggtattcaagctattgctgactgggtgccagaccaaatctataacctcccaggaaaagaagtggtaaatgcgacacgtgttaacggttatggtaaccaccaaataggctaccaaatcattgaccaagcctatgtggctaatacccgtacagatggtacagactatcaaggtaaatacggtggtgctttccttgatgagcttaaagctaagtacccatctattttcaaccgagtgcaaatctcaaatggtaagcagttgcctacgaatgaaaagattaccaagtggtctgctaagtacttcaacggaactaacatccttggacgaggcatcaattatgtccttcgtgatgacaagaccaaccagtactttaatacttcagccaacggccaactcttgccaacaccacttcgtgacacaggtgccattacaagcactcaagtcttccaacgtcgtggacaagatgtttacttccttcgtgataatcaagtcatcaagaatgaatttgttcaagacggtaacggtaactggtattacttcggtgctgacggtaagatgactaagggtgcccaaaacatcaatagcaaggattactatttctttgataatggtgttcaattgcgtaatgccctgcgtcgtgctaacaatggttatacttactattacggtttagacggtgctatggttaagaatgcttttgttgattttgacgacaagcgtaagcaggtgcgtgcctttacgactcaaggaaccatggtagtgggtaaccttcattggagtggtcaccatttctactttgaccgtgaaactggtattcaggccaaggatcgtattgtccgtacagatgatggcaaattgcattactatgttgcagaaactggtgacatgggacgcaatgtctttgcgacagatagtagcacaggtaaacgttattactttgacgctgatggtaacactgtgactggttcacgtgtcattgacggtaagacttattactttaaccaagatggtagtgtcggtacggcctacagcaaccgagctgattctattatctttgaaaatggtaaggcccgttacatcacaccagcaggcgaaatcggacgtagcatctttgtctacaatccagcgactaaggcttggaactactttgataaagaaggtaaccgtgtgacaggtcgtcaatacattgatggtcacctctattacttcaaggaagatggtagccaagctaagggtgaaattattgaagaaaatggcatcaagtattactatgagccagaatcaggtattcttgcttcaggacgctacctccaagttggtgatgaccagtggatgtacttcaaacaagacggttcactggctatcggccaagttcgtgctgatcatggatatcttaagtactttgataaaaatggtatccaagtcaagggtaaaaccattgtcgaagatggtaagacttattactatgatgcccacagtggagctcttgtcacaagcagctttgctgagattgcaccaaaccaatggtcttacttcaatactgaaggccaagcacttaaaggcaattggactatcaatggcaaggaatactactttgaccaaaatgggattcagtacaagggcaaggccgttaaggtcggcagtcgttacaagtactatgacgaaaacgatggacaacctgtaaccaaccgcttcgctcaaatcgagcctaacgtctgggcttactttggagcagatggttatgccgtgacaggggaacaagtcatcaatggacaacacctttactttgaccaatcaggtcgccaagttaaaggtgcctacgtcacagtcaacggtcaacgtcgttactacgatgttaacactggcgaatatgtcccaggaagataa

SEQ ID NO: 98 - protein, 1392 aa, Streptococcus salivarius CCHSS3
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSINQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNQDIDKAHKTYASYNLPSVYALMLTNKDSVTRVYYGDLYRENGHYMAKKTPYFDAIDTLLRARIKYVAGGQDMEVKKVGNDGLLTSVRYGKGANNRTDWGTSETRTQGMGVIMTNNYDFRLGSNETVTMNMGRAHRNQLYRPLLLTTKDGIATYLNDSDVPKNLLKRTDWNGNLTFNANDVFGVENVQVSGYLGVWVPVGAKANQDARTQPSNRTNSDGQVYKSSAALDSQVMYEAFSNFQAFADDQPELYMNRVLAKNTDLLKAWGITSVGLPPQYVSSKDGTFLDSTIDNGYAFDDRYDMALSQNNKYGSLEDLLNVLRALHKDGIQAIADWVPDQIYNLPGKEVVNATRVNGYGNHQIGYQIIDQAYVANTRTDGTDYQGKYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQVIKNEFVQDGNGNWYYFGADGKMTKGAQNINSKDYYFFDNGVQLRNALRRANNGYTYYYGLDGAMVKNAFVDFDDKRKQVRAFTTQGTMVVGNLHWSGHHFYFDRETGIQAKDRIVRTDDGKLHYYVAETGDMGRNVFATDSSTGKRYYFDADGNTVTGSRVIDGKTYYFNQDGSVGTAYSNRADSIIFENGKARYITPAGEIGRSIFVYNPATKAWNYFDKEGNRVTGRQYIDGHLYYFKEDGSQAKGEIIEENGIKYYYEPESGILASGRYLQVGDDQWMYFKQDGSLAIGQVRADHGYLKYFDKNGIQVKGKTIVEDGKTYYYDAHSGALVTSSFAEIAPNQWSYFNTEGQALKGNWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDVNTGEYVPGR

SEQ ID NO: 99 - DNA, 4179 bp, Streptococcus salivarius M18
atcaacggcaaacaatactatgtcaatagtgacggtagtgtgcgtaagaacttcgtctttgagcaagacggtaagtcttattactttgatgctgaaacaggggctcttgcgaccaagtcacaggatgaattttcaacagaacctatcaaggcgactgtggatttttcatctggaaaccagctctacaaaaacgatgacaaatctttggaccaactggacaccttcatcacagcggatgcttggtaccgtccaaagagtattctcaaggatggtaagacttggacagcttcaaccgaggctgacaaacgtccacttttgatggtttggtggcctgacaaatcgactcaggttaattaccttaactacatgcaaaatcaaggtcttggtgcaggatcattttcaactaactctagtcaggaaagtctggatcaagctgccaagatggttcagactaagattgaagaacgtatcgcgcgtgaaggcaataccaactggttgcgtacaagtatcgaccagttcattaaaactcaaccaggttggaatagcagtactgaaaatagttcatacgaccacttgcaacgtggacagttgctctttaacaatagtaagggtgatactggtaaccgtaccagccatgccaactctgactatcgtttgttaaaccgcacaccgactaaccaaacgggtacacgtaagtacttcaaggacaattctatcggtggtcttgagttcttgcttgccaacgatattgataactcaaacccagctgttcaggcagaacaacttaactggctccactttatgatgaatatcggaagcatcatggctaatgacccaacagctaactttgacggtttgcgtgtcgatgccttggacaatgtggatgccgacctgctccaaatcgcatcagactacttcaaagcagcttatggtgtggacaagtctgaagctaatgccatcaaacacttgtcatacttggaagcatggtctgccaacgacccatactataacaaggacactaagggagcacaacttccgattgacaatgcccttcgtaatgcccttaccaacctcctgatgcgtgataaaaatacacgtatgcagcttggggacatgactgctttcatcaacagtagtttgaatccacgtggtgccaacgataagaacggtgagcgtatggctaactatattttcacccgtgcccacgatactgaggctcaaacaattattcaacgtatcattcgtgatcgtattaacccaaatttgtttggttacaatttcacccgtgatgaaatcaagaaggccttcgagatttacaatgcggatattgataaggctcataaaacttatgcgtcttacaacttgccatctgtctatgccctcatgttgaccaacaaggactctgtaacacgtgtttattacggtgacctctaccgtgaggatggtcactacatggcgaaaaagacgccttactttgatgccattgacacccttttgcgtgcccgtatcaagtatgtagctggtggtcaagacatggaagtgaagaaagtcggaaatgacggcctcttgacatcagttcgttatggtaaaggtgccaataacagaactgattggggaactgctgaaacccgtacgcaagggatgggtgtcatcatgaccaacaactatgatttccgattgggtagcaatgaaactataacgatgaatatgggtagagcccaccgtaatcagctttaccgtccattgcttttgacgactaaggatggtctagcaacctacctcaacgattctgacgtaccttcaaaccttcttaaacgtaccgactggaatgggaacttgaccttcaatgccaatgatatttttggtgtggaaaatgtgcaagtttcaggttacctcggtgtctgggtaccagtcggggcgaaggctaaccaagacgcacgtacacagccaagtaaccgtgccaatagcgatggtcaagtttacaagtcttcagcagcccttgattcgcaagtcatgtatgaagccttctcaaacttccaagcatttgcggacgatcagccagaactctacatgaaccgtgtcttggctaagaacactaatttgctcaaagcatggggtgttacgtctgttggacttccaccacagtacgtttcaagtaaagatggtaccttcctcgattcaacgattgacaatggttatgcctttgacgaccgttatgacatggccttgagtcaaaataacaagtatggctcacttgaggacctccttaatgtccttcgtgccctccacaaagatggtattcaagccattgctgactgggtgccagaccaaatttataaccttccaggaaaagaagtagttaatgccacacgtgttaacggctacggttatcaccaacaaggttatcaaattgtggaccaagcctatgtggcaaatacccgcacagatggcacagactatcaaggcaagtacggtggtgccttccttgatgagctgaaagctaagtacccatctattttcaaccgtgtgcaaatctcaaatggtaagcagttgcctacgaatgaaaagattaccaaatggtctgctaagtacttcaacggaaccaacatccttggacgaggtatcaactttgtccttcgtgatgacaagaccaaccagtactttaatacctcagccaaaagccaactcttgccaataccacttcgtgatacgggtgccatcacaagcactcaagtcttccaacgtcgtggacaagatgtttacttccttcgcgataaccaaaccgttaagaatgaatttgttcaagacggtaacggtaactggtattacttcggtgctgacggtaagatgaccaagggtgcccaaaacatcaatagcaaggattactatttctttgacaatggtatccaattgcgtaatgctcttcgtcgtgcttcaaacggctatacttactattacggtctggacggtgctatggttaagaatgccttcgttgattttgatgacaaacgtaagcaagtccgtgcctttacaacacaaggaaacatggtagtgggtaaccttcattggagtggtcaccatttctactttgaccgtgaaacgggtatccaggctaaggatcgcgttgttcgtacagatgatggcaaattgcattactatgttgctgaaactggtgacatgggacgtaacgtctttgcgacagacagcagcacaggtaaacgttattactttgacgctgatggtaacactgtgactggctcacgtgtcattgacggtaagacttattactttaaccaagatggtagtgtcggtacggcctacagcaatcgtgcagattctattatctttgaaaatggtaaggctcgctacatcacaccagcaggcgaaatcggacgtagcatctttgtctacaacccagcaactaaggcatggaactactttgataaagaaggtaaccgtgtcacaggacgccaatacattgatggtcacctctattacttcaaggaagatggtagccaagctaagggtgaaattatcgaggaaaacggcattaagtattactatgagccagaatcaggtattcttgcttcaggacgctacctccaagttggtgatgaccagtggatgtacttcaaacaagacggttcactggctatcggccaagttcgtgctgatcatggataccttaagtactttgataaaaatggtatccaagttaaggggaaaactgttgtcgaagatggtaagacttattactatgatgcccacagtggagctcttgtcacaagcagctttgctgagattgcgccaaaccaatggtcttacttcaatactgatggacaagcccttaaaggcaagtggactatcaatggcaaggaatactactttgacgaaaatggtatccaatacaaaggcaaggccattaaggtcggcagtcgttacaagtactatgacgaaaacgacggtcaacctgtaaccaaccgctttgctcaaatcgagcctaacgtctgggcttacttcggagcagatggttatgccgtaacaggcgaacaagtcatcaatggacaacacctttactttgaccaatcaggtcgccaagttaaaggtgcctacgtcacagtcaacggccaacgtcgttactacgatgccaacactggcgaatatgtcccaggaagataa

SEQ ID NO: 100 - protein, 1392 aa, Streptococcus salivarius M18
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKMVQTKIEERIAREGNTNWLRTSIDQFIKTQPGWNSSTENSSYDHLQRGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNADIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDWGTAETRTQGMGVIMTNNYDFRLGSNETITMNMGRAHRNQLYRPLLLTTKDGLATYLNDSDVPSNLLKRTDWNGNLTFNANDIFGVENVQVSGYLGVWVPVGAKANQDARTQPSNRANSDGQVYKSSAALDSQVMYEAFSNFQAFADDQPELYMNRVLAKNTNLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINFVLRDDKTNQYFNTSAKSQLLPIPLRDTGAITSTQVFQRRGQDVYFLRDNQTVKNEFVQDGNGNWYYFGADGKMTKGAQNINSKDYYFFDNGIQLRNALRRASNGYTYYYGLDGAMVKNAFVDFDDKRKQVRAFTTQGNMVVGNLHWSGHHFYFDRETGIQAKDRVVRTDDGKLHYYVAETGDMGRNVFATDSSTGKRYYFDADGNTVTGSRVIDGKTYYFNQDGSVGTAYSNRADSIIFENGKARYITPAGEIGRSIFVYNPATKAWNYFDKEGNRVTGRQYIDGHLYYFKEDGSQAKGEIIEENGIKYYYEPESGILASGRYLQVGDDQWMYFKQDGSLAIGQVRADHGYLKYFDKNGIQVKGKTVVEDGKTYYYDAHSGALVTSSFAEIAPNQWSYFNTDGQALKGKWTINGKEYYFDENGIQYKGKAIKVGSRYKYYDENDGQPVTNRFAQIEPNVWAYFGADGYAVTGEQVINGQHLYFDQSGRQVKGAYVTVNGQRRYYDANTGEYVPGR

SEQ ID NO: 101 - DNA, 4179 bp, Streptococcus sp. HSISS4
attaacggcaaacaatactatgtcaatagtgacggtagtgtgcgtaagaacttcgtttttgagcaagatggtaagtcatattactttgatgctgaaacaggggctcttgcgaccaagtcacaggatgaattttcaactaaacctatcaaggcgactgtagatttttcatctggaaatcagctctacaaaaacgataacaaatctttggaccaactcgactccttcatcactgcggatgcttggtaccgtccaaagagtattctcaaggatggtaagacttggacagcttcaactgaagcggacaaacgtccactcttgatggtttggtggcctgacaaatcaactcaggttaactacctaaactacatgcaaaatcaaggtcttggtgcgggatcattttcaaccaactctagccaggaaagtctaaatctagctgctaaaacggttcagactaagattgaagaacgtattgcgcgtgaaggcaataccaactggttgcgtacaagtattgatcagtttatcaagactcagcctggttggaatagtagcactgaaaatagttcatacgaccacttgcaaggtggacagttgctctttaacaacagtaagggtgatactggtaaccgtactagctacgccaactctgactatcgtttgcttaaccgcacaccgactaatcagacgggtacacgtaagtacttcaaggacaattctatcggtggtcttgagttcttgcttgccaacgatattgataactcaaacccagctgttcaggcggagcaacttaactggctccactttatgatgaatatcggaagtatcatggcaaatgacccaactgctaactttgacggtttgcgtgtcgatgccttggacaatgtggatgctgaccttctccaaatcgcttcagattacttcaaagcagcctatggtgttgacaagtccgaagctaatgcgatcaaacacttgtcatacttggaagcgtggtctgccaacgacccatattacaacaaggacaataagggggcacaactgccgattgataatgcccttcgtaatgctcttaccaaccttttgatgcgtgataaaaatacacgtatgcagcttggggacatgactgcttttatgaatagtagtttgaatccacgaggtgctaacgataagaacggtgaacgtatggcaaactatattttcacccgtgcccacgatacggaagcgcaaaccattatccaacgtatcatccgtgatcgtatcaacccaaatctgtttggttacaatttcacccgtgatgaaataaagaaggccttcgagatttacaatgcggatattgataaggctcacaagacttatgcgtcatacaacttgccatctgtctatgccctcatgttgaccaacaaggactctgtaacacgtgtttattacggggacctctaccgtgaggatggtcactacatggcgaaaaagacgccttactttgatgctatcgacaccctcttgcgtgcccgtatcaagtatgtagctggcggtcaagacatggaagtgaagaaagtcggaaatgacggcctcttgacatcagttcgttatggtaaaggtgccaataacagaactgattggggaactgctgaaacccgtacgcaagggatgggtgtcatcatgaccaacaactatgatttccgattgggtagcaatgaaactgtaacgatgaatatgggtagagcccaccgtaatcagctttatcgcccattacttttgacaacaaaagatggtatagcaacctacctcaacgattctgatgtgcctaaaaaccttcttaaacgtaccgactggaatgggaacttgaccttcaacgccaacgatgtttttggtgttgaaaatgtccaagtctcaggttatctcggtgtctgggtaccagtcggggctaaggctaaccaagacgcacgtacacagccaagtaaccgtgccaatagcgatggtcaagtttacaagtcttcagcagcccttgattcgcaagttatgtatgaagccttctcaaacttccaagcatttgcggacaatcagccagaactctacatgaaccgtgtcttggctaagaacactaatttgctcaaagcatggggtgttacgtctgttggacttccaccacagtacgtttcaagtaaggatggtaccttccttgattcaacaattgacaatggttatgcctttgatgaccgttacgatatggccttgagtcaaaataataaatacggctcacttgaggacctccttaacgttcttcgtgccctccataaagacggtattcaagccattgctgattgggtgccagaccaaatctataaccttccaggaaaagaagtggtaaatgcgacacgtgttaacggctacggaaaccatcaaggaggctaccaaattattgaccaagcctatgtggcaaatacccgtacagatggtacagactatcaaggtaaatacggtggtgccttccttgatgagcttaaagctaagtacccatctattttcaaccgtgttcaaatctcaaatggtaagcagttgccaacgaatgaaaagattaccaaatggtctgctaagtacttcaacggaactaacatccttggacgaggcatcaactatgtccttcgtgatgacaagaccaaccagtacttcaatacttcagccaacggccaactcttgccaacaccacttcgtgacacaggtgccatcacaagcactcaagtcttccaacgtcgtggacaagacgtttacttccttcgtgataaccaaaccgttaagaatgaatttgttcaagatggtagtggtaactggtattacttcggtggtgacggtaagatgaccaagggtgctcgaaacatcaataacaaggattactatttctttgacaatggtatccaattgcgtaacgcccttcgtcgtgcttcaaacggctatacctactattacggtctggacggtgccatggttaagaatgccttcgttgattttgatgacaagcataagcaggtccgtgcctttacgactcaaggaacaatggtagtgggtaaccttcattggagtagccaccatttctactttgaccgtgaaacgggtatccaggctaaggatcgcgttgttcgtacagatgatggcaaattgcattactatgttgctgaaactggtgacatgggacgtaacgtctttgcgacagacagcagcacaggtaaacgttattactttgacgctgatggtaacactgtgactggctcacgtgtcattgacggtaagacttattactttaaccaagatggtagtgtcggtacggcctacagcaatcgtgcagattctattatctttgaaaatggtaaggctcgctacatcacaccagcaggcgaaatcggacgtagcatctttgtctacaacccagcaactaaggcatggaactactttgataaagaaggtaaccgtgtcacaggacgccaatacattgatggtcacctctattacttcaaggaagatggtagccaagctaagggtgaaattatcgaggaaaacggcattaagtattactatgagccagaatcaggtattcttgcttcaggacgctacctccaagttggtgatgaccagtggatgtacttcaaacaagacggttcactggctatcggccaagttcgtgctgatcatggataccttaagtactttgataaaaatggtatccaagtcaagggtaaaaccattgttgaagatggtaagacttattactatgatgcccacagtggagctcttgtcacaagcagctttgctgagattgcaccaaaccaatggtcttacttcaatactgatggacaagcccttaaaggcaagtggactatcaatggcaaggaatactactttgaccaaaatggtatccaatacaagggcaaagccgttaaggtcggtagtcgttacaagtactatgacgaaaacgatggtcaacctgtaaccaaccgctttgctcaaatcgagccaaacgtttgggcttatttcggagctgatggctatgccgtaacaggcgaacaagtcatcaatggacaacacctttactttgaccaatcaggtcgccaagttaaaggagcctacgtcacagtcaatggacaacgccgttattacgatgccaacactggcgaatatgtcccaggaagataa

SEQ ID NO: 102 - protein, 1392 aa, Streptococcus sp. HSISS4
INGKQYYVNSDGSVRKNFVFEQDGKSYYFDAETGALATKSQDEFSTKPIKATVDFSSGNQLYKNDNKSLDQLDSFITADAWYRPKSILKDGKTWTASTEADKRPLLMVWWPDKSTQVNYLNYMQNQGLGAGSFSTNSSQESLNLAAKTVQTKIEERIAREGNTNWLRTSIDQFIKTQPGWNSSTENSSYDHLQGGQLLFNNSKGDTGNRTSYANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDNKGAQLPIDNALRNALTNLLMRDKNTRMQLGDMTAFMNSSLNPRGANDKNGERMANYIFTRAHDTEAQTIIQRIIRDRINPNLFGYNFTRDEIKKAFEIYNADIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDWGTAETRTQGMGVIMTNNYDFRLGSNETVTMNMGRAHRNQLYRPLLLTTKDGIATYLNDSDVPKNLLKRTDWNGNLTFNANDVFGVENVQVSGYLGVWVPVGAKANQDARTQPSNRANSDGQVYKSSAALDSQVMYEAFSNFQAFADNQPELYMNRVLAKNTNLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGNHQGGYQIIDQAYVANTRTDGTDYQGKYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQTVKNEFVQDGSGNWYYFGGDGKMTKGARNINNKDYYFFDNGIQLRNALRRASNGYTYYYGLDGAMVKNAFVDFDDKHKQVRAFTTQGTMVVGNLHWSSHHFYFDRETGIQAKDRVVRTDDGKLHYYVAETGDMGRNVFATDSSTGKRYYFDADGNTVTGSRVIDGKTYYFNQDGSVGTAYSNRADSIIFENGKARYITPAGEIGRSIFVYNPATKAWNYFDKEGNRVTGRQYIDGHLYYFKEDGSQAKGEIIEENGIKYYYEPESGILASGRYLQVGDDQWMYFKQDGSLAIGQVRADHGYLKYFDKNGIQVKGKTIVEDGKTYYYDAHSGALVTSSFAEIAPNQWSYFNTDGQALKGKWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYVPGR

SEQ ID NO: 103 - DNA, 4179 bp, Streptococcus salivarius SK126
attaacggcaaacaatactatgtcaatagtgacggtagtgtgcgtaagaactttgtctttgagcaagatggtaagtcttattactttgatgctgaaacaggggctcttgcgactaagtcacaggatgaattttcaacagaaccaatcaaggcaaccgtcgatttttcatctggaaaccagctctacaaaaacgatgataaatcgttggaccagctcgataccttcatcacagcggatgcttggtaccgtccaaagagcattctcaaggatggtaagacttggacggcttcaactgaggctgacaaacgtccactcttgatggtttggtggcctgacaagtcaactcaggttaactaccttaactacatgcaaaatcaaggtcttggtgcaggctcattttcaaccaactctagccaggaaagtctggaccaagctgctaaagcggttcagactaagattgaagaacgtatcgctcgtgaaggcaacacaaactggttgcgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgactaaccagacgggtacacgtaagtacttcaaggacaattctatcggtggtcttgagttcttgcttgccaacgatattgataactcaaacccagctgttcaggcagagcaacttaactggctccactttatgatgaatattggaagcatcatggcaaatgacccaacagctaactttgacggtttgcgtgtcgatgccttggacaatgtggatgctgaccttctccaaatcgcatcagactacttcaaagcagcctatggtgttgacaagtctgaagccaatgccattaagcacttgtcatacttggaagcatggtctgccaacgacccatactacaataaggacactaagggggcacaacttccgattgacaatgccctccgtaatgcccttaccaacctcttgatgcgtgataagaatacacgtatgcagcttggggacatgactgccttcatcaacagtagtttgaatccacgtggtgccaacgataaaaacggtgaacgtatggcaaactatattttcacccgtgctcacgatacggaagctcaaacgattattcaacgtatcatccgtgatcgtatcaacccaaatttgtttggttacaatttcactcgtgatgaaatcaagaaagccttcgagatttacaatgaggatattgataaggctcacaagacttatgcgtcatacaacttaccatctgtttatgctctcatgttgaccaacaaggactctgtaacacgagtttattacggagacctctaccgtgaagatggtcactacatggctaaaaagacaccgtactttgatgccattgacaccctcttgcgtgctcgtatcaagtatgtagctggtggtcaagacatggaagtgaagaaagtcggaaatgacggcctcttgacatctgttcgttatggtaaaggtgccaataacagaacagatttgggaacttcagaaactcgtacgcaaggtatgggtgtcatcatgaccaacaactatgatttccgcttgggtagcaatgaaactgtaacgatgaacatgggtagagcacaccgtaatcagctttatcgcccattgcttttgacgacaaaggatggtatagcaacctacttcaacgattctgatgtgcctaaaaaccttctgaaacgtactgactggaatgggaacttgaccttcaatgccaatgatgtttttggtgtggaaaatgtccaagtatcaggttaccttggtgtctgggtaccagtcggggctaaggctaaccaagacgcacgtacacagccaagtaaccgtgccaatagcgatggtcaagtttacaagtcttcagcagcccttgattcgcaagtcatgtatgaagccttctcaaacttccaagcatttgcggacgatcagccagaactctacatgaaccgtgtcttggctaagaacactgacttgctcaaagcatggggtgttacgtctgttggacttccaccacagtacgtttcaagtaaggatggtaccttccttgattcaacaattgacaatggttatgcctttgatgaccgttatgacatggccttgagtcaaaataacaagtatggctcacttgaggacctccttaatgttcttcgtgccctccacaaagatggtattcaagccattgctgactgggtgccagaccaaatttataaccttccaggaaaagaagtagttaatgccacacgtgttaacggctacggttatcaccaacaaggttatcaaattgtggaccaagcctatgtggcaaatacccgtacagatggtacagactatcaaggtaaatacggtggagccttccttgatgagcttaaagctaagtacccatctattttcaaccgtgtgcaaatctcaaatggtaagcagttacctacgaatgaaaagattactaaatggtctgctaagtacttcaacggaactaatatccttggacgaggtatcaactatgtccttcgtgatgacaagaccaaccagtactttaatacctcagctaacagccaactcttgccaacaccacttcgtgacacaggtgccattacaagcactcaagtcttccaacgtcgtggacaagatgtttacttccttcgtgataaccaagccgttaagaatgaatttgttcaagacggtaacggcaactggtattacttcggtgctgacggtaagatgaccaagggtgctcaaaccatcaataaaaaggattactatttctttgacaatggtatccaattgcgtaacgcccttcgtcgtgctaacaacggttatacttactattacggtttagacggtgctatggttaagaatgcctttgttgattttgacgacaagcgtaagcaggtgcgtgcctttacgacacaaggaaccatggtagtgggtaaccttcattggagtggacaccatttctactttgaccgtgaaactggtattcaagccaaggatcgcattgtccgtacagatgatggcaaattgcattactatgttgctggaaccggtgatatgggacgtaacgtctttgcgacagatagtagcacaggcaaacgttattactttgacgcagatggtaatactgtgactggttcacgtgtcattgacggtaagacttattactttaaccaagatggtagtgtcggtacggcctacagcaaccgagctgattctattatctttgaaaatggtaaggctcgctacatcacaccagcaggcgaaatcggacgtagcatctttgtctacaacccagcaactaaggcttggaattactttgataaagaagggaaccgtgtcacaggacgtcaatacattgatggtcacctctattacttcaaggaagatggtagccaagctaagggtgaaattatcgaggaaaacggcattaagtattactatgagccagaatcaggtattcttgcttcaggacgctacctccaagttggtgatgaccagtggatgtacttcaaacaagacggttcactggcaatcggacaagttcgtgctgatcatggataccttaagtactttgataaaaatggtatccaagtcaagggtaaaaccattgttgaagatggtaagacttattactatgatgctcatagtggagctcttgtcacaagcagctttgctgagattgcaccaaaccaatggtcttacttcaatactgatggacaagcccttaaaggcaagtggactatcaatggcaaggaatactactttgaccaaaatggtatccaatacaagggcaaagccgttaaggtcggtagtcgttacaagtactatgacgaaaacgatggtcaacctgtaaccaaccgcttcgctcaaatcgagcctaacgtctgggcttatttcggagctgatggctatgccgtgacaggcgaacaagtcatcaatggacaacacctttactttgaccaatcaggtcgccaagttaaaggtgcctacgtcacagtcaatggacaacgtcgttactacgatgccaacactggtgaatatgtaccaggaagataa

SEQ ID NO: 104 - protein, 1392 aa, Streptococcus salivarius SK126
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYFNDSDVPKNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGADGKMTKGAQTINKKDYYFFDNGIQLRNALRRANNGYTYYYGLDGAMVKNAFVDFDDKRKQVRAFTTQGTMVVGNLHWSGHHFYFDRETGIQAKDRIVRTDDGKLHYYVAGTGDMGRNVFATDSSTGKRYYFDADGNTVTGSRVIDGKTYYFNQDGSVGTAYSNRADSIIFENGKARYITPAGEIGRSIFVYNPATKAWNYFDKEGNRVTGRQYIDGHLYYFKEDGSQAKGEIIEENGIKYYYEPESGILASGRYLQVGDDQWMYFKQDGSLAIGQVRADHGYLKYFDKNGIQVKGKTIVEDGKTYYYDAHSGALVTSSFAEIAPNQWSYFNTDGQALKGKWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYVPGR

SEQ ID NO: 105 - DNA, 4179 bp, Streptococcus salivarius JIM8777
atcaacggcaaacaatactatgtcaatagtgacggtagtgtgcgtaagaactttgtttttgagcaagatggtaagtcttattactttgatgctgaaacaggggctcttgcgactaagtcacaggatgaattttcaacagaacctatcaaggcaaccgtagatttttcatctggtaaccagctctacaaaaacgatgacaaatctttggaccaacttgacaccttcatcacagcggatgcttggtaccgtccaaagagcattctcaaggatggtaagacttggacagcttcaactgaagctgacaaacgtcctctcttgatggtttggtggcctgacaagtctactcaggtcaactaccttaactacatgcaaaatcaaggtcttggtgcagggtcattttcaaccaactctagccaggaaagtctggaccaagctgctaaagcggttcagactaagattgaagaacgtatcgcgcgtgagggcaataccaactggttgcgtacaagtatcgaccagttcatcaagacacagccaggttggaatagtagcactgaaaatagttcatacgaccacttgcaaggcggacagttgctctttaacaacagtaagggtgatactggcaaccgtaccagccacgccaactctgactatcgtttgttaaaccgcacaccgactaaccagacgggtacacgtaagtacttcaaggataattctatcggtggtcttgagttcttgcttgccaacgatattgataactcaaacccagctgttcaggcagagcaacttaactggctccactttatgatgaatatcggaagcatcatggctaatgacccaactgccaactttgacggtttgcgtgtcgatgccttggacaatgtggatgccgacctgctccaaatcgcatcagactacttcaaagcagcctatggtgttgacaagtctgaagccaatgccatcaagcacttgtcatacttggaagcatggtctgccaacgacccatactacaacaaggacactaagggagcacaacttccgattgacaatgcccttcgtaatgccctcaccaacctcttgatgcgtgataaaaatacacgtatgcagcttggagacatgactgctttcatcaacagtagtttgaacccacgaggtgccaacgataaaaacggtgaacgtatggcaaactatattttcacccgtgcccatgatacagaagctcaaaccattattcaacgtatcattcgtgatcgtattaacccaaatttgtttggttataatttcacacgtgatgaaatcaagaaagccttcgagatttacaatgaggatattgataaggctcacaagacttatgcgtcatacaacttgccatctgtctatgccctcatgttgaccaataaggactctgtaacacgtgtttattacggagacctctaccgtgaagatggtcactacatggctaagaagacgccttactttgatgccatcgacaccctcttgcgtgcccgtatcaagtatgtagctggtggtcaagacatggaagtgaagaaagtcggaaatgacggcctcttgacatcagttcgttatggtaaaggtgccaataacagaactgatttgggaacttctgaaactcgtacgcaaggtatgggtgtcatcatgaccaacaactatgatttccgcttgggtagcaatgaaactgtaacgatgaacatgggtagagctcaccgtaatcagctttatcgaccattgcttttgacgacaaaggatggtatagcaacctacctcaacgattctgatgtgcctaaaaaccttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaataattgataatggttatgcctttgatgaccgttacgatatggccttgagtcaaaataataaatacggatcacttgaggacctccttaacgttcttcgtgccctccataaagacggtattcaagccattgctgactgggtaccagaccaaatctataacctcccaggaaaagaagtggtaaatgcgacacgtgttaacggctacggttatcaccaacaaggttatcaaattgtggaccaagcctatgtggcaaatacccgtacagatggtacagactatcaaggcaagtacggtggtgccttccttgatgagctgaaagctaagtacccatctattttcaaccgtgtgcaaatctcaaatggtaagcaattgcctacgaatgaaaagattacaaaatggtctgctaagtacttcaacggaaccaacatccttggacgaggcatcaactttgtccttcgtgatgacaagaccaaccagtactttaatacttcagctaacagccaactcttgccaacaccacttcgtgatacgggtgccatcacaagcactcaagtcttccaacgtcgtggacaagatgtttacttccttcgcgataaccaaaccgttaagaatgaatttgttcaagacggtaacggtaactggtattacttcggtggtgacggtaagatgaccaagggtgcccaaaacatcaatagcaaggattactatttctttgataatggtgttcaattgcgtaatgccctgcgtcgtgcttcaaacggctatacttactattacggtctggacggtgctatggttaagaatgccttcgttgattttgatgacaagcataagcaggtccgtgcctttacgactcaaggaacaatggtagtgggtaaccttcattggagtggacaccatttctactttgaccgtgaaacgggtatccaggctaaggatcgcgttgttcgtacagatgatggcaaattgcattactatgttgctgaaactggtgacatgggacgtaacgtctttgcgacagacagcagcacaggtaaacgttattactttgacgctgatggtaacactgtgactggctcacgtgtcattgacggtaagacttattactttaaccaagatggtagtgtcggtacggcctacagcaatcgtgcagattctattatctttgaaaatggtaaggctcgctacatcacaccagcaggcgaaatcggacgtagcatctttgtctacaacccagcaactaaggcatggaactactttgataaagaaggtaaccgtgtcacaggacgtcaatacattgatggtcacctctattacttcaaggaagatggtagccaagctaagggcgaaattatcgaggaaaacggcattaagtattactatgagccagaatcaggtattcttgcttcaggacgctacctccaagttggtgatgaccagtggatgtacttcaaacaagacggttcactggctatcggccaagttcgtgctgatcatggataccttaagtactttgataaaaatggtatccaagttaaggggaaaactgttgtcgaagatggtaagacttattactatgatgcccacagtggagctcttgtcacaagcagctttgctgagattgcaccaaaccaatggtcttacttcaatactgatggacaagcccttaaaggcaagtggacgatcaatggcaaggaatactactttgacgaaaatggtatccaatacaaaggcaaggccattaaggtcggtagtcgttacaagtactatgacgaaaacgacggtcaacctgtaactaatcgctttgctcaaatcgagcctaacgtctgggcatacttcggagcagattgctatgccgtaacaggcgaacaagtcatcaatggacaacacctttactttgatgaaaatggtcgccaagttaagggtgcctacgttacagtcaacggccaacgccgttactacgatgctaacactggcgaatatgtcccaggaagataa

SEQ ID NO: 106 - protein, 1392 aa, Streptococcus salivarius JIM8777
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKNLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSIIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINFVLRDDKTNQYFNTSANSQLLPTPLRDTGAITSTQVFQRRGQDVYFLRDNQTVKNEFVQDGNGNWYYFGGDGKMTKGAQNINSKDYYFFDNGVQLRNALRRASNGYTYYYGLDGAMVKNAFVDFDDKHKQVRAFTTQGTMVVGNLHWSGHHFYFDRETGIQAKDRVVRTDDGKLHYYVAETGDMGRNVFATDSSTGKRYYFDADGNTVTGSRVIDGKTYYFNQDGSVGTAYSNRADSIIFENGKARYITPAGEIGRSIFVYNPATKAWNYFDKEGNRVTGRQYIDGHLYYFKEDGSQAKGEIIEENGIKYYYEPESGILASGRYLQVGDDQWMYFKQDGSLAIGQVRADHGYLKYFDKNGIQVKGKTVVEDGKTYYYDAHSGALVTSSFAEIAPNQWSYFNTDGQALKGKWTINGKEYYFDENGIQYKGKAIKVGSRYKYYDENDGQPVTNRFAQIEPNVWAYFGADCYAVTGEQVINGQHLYFDENGRQVKGAYVTVNGQRRYYDANTGEYVPGR

SEQ ID NO: 107 - DNA, 4179 bp, Streptococcus sp. SR4
attaacggcaaacaatactatgtcaatagtgacggtagtgtgcgtaagaactttgtctttgagcaagatggtaagtcttattactttgatgctgaaacaggggctcttgcgaccaagtcacaggatgaattttcaacagaacctatcaaggcaaccgtagatttttcatctggaaaccagctctacaaaaacgatgacaagtctttggaccaactcgacaccttcatcacagcggatgcttggtaccgtccaaagagcattctcaaggatggtaagacttggacagcttcaactgaagcggacaaacgtccactcttgatggtttggtggcctgacaagtcaactcaggttaactacctcaactatatgcaaaatcaaggtcttggtgcaggctcattctcaaccaactctagccaggaatcactagaccaagctgccaagatggttcagactaagattgaagaacgtatcgctcgtgaaggaaacacaaactggttgcgtacaagtatcgaccagttcatcaagactcagccaggttggaatagtagcactgaaaatagttcatacgaccacttgcaaggtggacagttgctctttaacaacagtaagggtgatactggcaaccgtacgagtcacgccaactctgactatcgtttgcttaaccgcacaccgactaaccagacgggtacgcgtaagtacttcaaggacaattctatcggtggtcttgagttcttgcttgccaacgatattgataactcaaacccagcagttcaggcagagcaacttaactggcttcactttatgatgaatatcggaagcatcatggcgaatgacccaacagcaaactttgacggtttgcgtgtcgatgccttggacaatgtggatgccgaccttctccaaatcgcttcagattacttcaaagcagcctatggtgtggacaagtctgaagccaatgccattaagcacttgtcatacttggaagcatggtctgccaacgacccatactataacaaggacactaagggggcacaacttccgattgataatgcccttcgtaatgcccttaccaacctcttgatgcgtgataaaaatacacgtatgcagcttggggacatgactgctttcatcaacagtagtttgaatccacgtggtgctaacgataaaaatggtgaacgtatggctaactatattttcacccgtgcccacgatacggaagctcaaacgattatccaacgtatcatccgtgatcgtatcaatccaaatttgtttggctacaatttcactcgtgatgaaatcaagaaagccttcgagatttacaatgaggatattgataaggctcacaagacttatgcgtcatacaacttgccatctgtttatgctctcatgttgaccaacaaggactctgtaacacgtgtttattacggagacctctatcgtgaggatggtcactacatggctaaaaagacgccttactttgatgccatcgacaccctcttgcgtgctcgtatcaagtatgtagctggtggtcaagacatggaagtgaagaaagtcggaaatgatggcctcttgacatctgttcgttatggtaaaggtgccaataacagaactgatttgggaacttcagaaactcgtacgcaaggtatgggtgtcatcatgaccaacaactatgatttccgcttgggtagcaatgaaactgtaacgatgaacatgggtagagcacaccgtaatcagctttatcgcccattgcttttgacaacaaaagatggtatagcaacctacctcaacgattctgatgtgcctaaaaaccttcttaaacgcactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcatttgcggacgatcagccagaactctacatgaaccgtgtcttggctaagaacactgacttgctcaaagcatggggaatcacgtcggtcggacttccaccacagtatgtttcaagtaaagatggcactttccttgactcaacaattgataatggttatgcctttgatgaccgttacgatatggccttgagtcaaaataataaatacggatcacttgaggacctccttaacgttcttcgtgccctccataaagacggtattcaagccattgctgactgggtgccagaccaaatctataacctcccaggaaaagaagtggtaaatgcgacacgtgttaatggttatggtaaccaccaagtaggctaccaaatcattgaccaagcctatgtggctaatactcgtacagatggtacagactatcaaggtaaatacggtggtgccttccttgatgagcttaaagctaagtacccatctattttcaaccgtgtgcaaatctcaaatggaaaacagttgcctacgaatgaaaagattactaaatggtctgctaagtacttcaacggaactaatatccttggacgaggtatcaactatgtccttcgtgatgacaagactaaccagtactttaatacttcagccaacagccaactcttgccaacaccacttcgtgatactggtgccatcacaagcactcaagtcttccaacgtcgtggacaagatgtttatttcctacgtgataaccaagctgttaagaatgaatttgttcaagatggtaacggcaactggtattactttggtggtgatggtaagatgaccaagggtgcccaaaacatcaataacaaggattactatttctttgacaatggtatccaattgcgtaacgcccttcgtcgtgcaagcaacggctatacctactattacggtctggacggcgcaatggttaagaatgccttcgttgattttgatgacaaacataagcaggttcgtgcctttacgactcaaggaacaatggtagtaggtaaccttcattggagtggtcaccatttctactttgaccgtgaaactggtatccaggctaaggatcgcgttgttcgtacagatgatggcaaattgcattactatgttgctgaaacgggtgacatgggacgtaacgtctttgcgacagacagcagcacaggtaaacgttattactttgacgctgatggtaacactgtgactggctcacgtgtcattgacggtaagacttattactttaaccaagatggtagtgtcggtacggcctacagcaatcgtgcagattctattatctttgaaaatggtaaggctcgctacatcacaccagcaggcgaaatcggacgcagcatctttgtctataacccagcaactaaggcttggaactactttgataaagaaggtaaccgtgtcacaggacgtcaatacattgatggtcacctctattacttcaaggaagatggtagccaagctaagggtgaaattatcgaggaaaacggcattaagtattactatgagccagaatcaggtattcttgcaagcggacgctacctccaagttggtgatgaccagtggatgtacttcaaacaagacggttcactggctatcggccaagttcgtgctgatcatggataccttaagtactttgataaaaatggtatccaagttaaggggaaaactgttgtcgaagatggtaagacttattactatgatgcccacagtggagctcttgtcacaagcagctttgctgagattgcaccaaaccaatggtcttacttcaatactgatggacaagcccttaaaggcaagtggactatcaatggcaaggaatactactttgacgaaaatggtatccaatacaaaggcaaggccattaaggtcggcagtcgttacaagtactatgacgaaaacgacggtcaacctgtaaccaaccgcttcgctcaaatcgagcctaatgtctgggcttactttggagcagatggttatgcagtgacaggggaacaagtcatcaatggacaacacctttactttgaccaatcaggtcgccaagttaaaggagcctacgtcacagtcaatggacaacgccgttactacgatgccaacactggcgaatatgtcccaggaagataa

SEQ ID NO: 108 - protein, 1392 aa, Streptococcus sp. SR4
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKMVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKNLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSTIDNGYAFDDRYDMALSQNNKYGSLEDLLNVLRALHKDGIQAIADWVPDQIYNLPGKEVVNATRVNGYGNHQVGYQIIDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGGDGKMTKGAQNINNKDYYFFDNGIQLRNALRRASNGYTYYYGLDGAMVKNAFVDFDDKHKQVRAFTTQGTMVVGNLHWSGHHFYFDRETGIQAKDRVVRTDDGKLHYYVAETGDMGRNVFATDSSTGKRYYFDADGNTVTGSRVIDGKTYYFNQDGSVGTAYSNRADSIIFENGKARYITPAGEIGRSIFVYNPATKAWNYFDKEGNRVTGRQYIDGHLYYFKEDGSQAKGEIIEENGIKYYYEPESGILASGRYLQVGDDQWMYFKQDGSLAIGQVRADHGYLKYFDKNGIQVKGKTVVEDGKTYYYDAHSGALVTSSFAEIAPNQWSYFNTDGQALKGKWTINGKEYYFDENGIQYKGKAIKVGSRYKYYDENDGQPVTNRFAQIEPNVWAYFGADGYAVTGEQVINGQHLYFDQSGRQVKGAYVTVNGQRRYYDANTGEYVPGR

SEQ ID NO: 109 - DNA, 4179 bp, Streptococcus salivarius 57.I
attaacggcaaacaatactatgtcaatagtgacggtagtgtacgtaaaaacttcgtttttgagcaagatggtaagtcttattactttgatgctgaaacaggggcacttgcgactaagtctcaggatgaattttcaacagaacctatcaaggcaaccgtagatttttcatctggaaaccagctctacaaaaacgatgacaagtctttggaccaactcgacaccttcatcacagcggatgcttggtaccgtccaaagagcattctcaaggatggtaagacttggacagcttcaactgaagcggacaaacgtcctctattgatggtttggtggcctgacaagtctactcaggtcaactaccttaactacatgcaaaatcaaggtcttggagcagggtcattttcaaccaactctagtcaggaaagtctggaccaagctgctaaagcggttcagactaagattgaagaacgtatcgcgcgtgagggcaataccaactggttacgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgacaaaccaaacgggtacacgtaagtacttcaaggacaattctatcggtggtcttgagttcttgcttgccaacgatattgataactcaaacccagctgttcaggcagaacaacttaactggctccactttatgatgaatatcggaagtatcatggcaaatgacccaactgccaactttgacggtttgcgtgtcgacgccttggacaatgtggatgccgaccttctccaaatcgcttcagattactttaaagcagcctatggggttgacaagtctgaagccaatgctattaagcacttgtcatatttggaagcatggtctgccaacgacccatactacaacaaggacactaagggagcacaacttccgattgataatgcccttcgtaacgcccttaccaacctcttgatgcgtgataaaaatacacgtatgcagcttggggacatgactgccttcatcaatagtagtttgaatccacgtggtgccaacgataaaaacggtgaacgtatggctaactatattttcactcgtgcccatgatacagaagctcaaacgattattcaacgtatcatccgtgatcgtattaacccaaatttatttggttacaatttcactcgtgatgaaatcaagaaagccttcgagatttacaatgaggatattgataaggctcacaagacttatgcgtcatacaacttaccatctgtctatgccctcatgttgaccaacaaggactctgtaacacgtgtttattacggagacctctatcgtgaagatggtcactacatggctaaaaagacaccgtactttgatgccatcgacaccctcttgcgtgctcgcatcaagtatgtagctggtggtcaagacatggaagtgaagaaagtcggaaatgatggactcttgacatctgttcgttatggtaaaggtgccaataacagaactgatttgggaacttctgaaacccgtacgcaagggatgggtgtcatcatgaccaacaactatgatttccgcttgggtagcaatgaaaccgtaacgatgaacatgggtagagctcaccgtaatcagctttatcgcccattgcttttgacgacaaaggatggtatagcaacctacctcaacgattctgatgtgcctaaaaaacttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaacaattgataatggttatgcctttgatgaccgttacgatatggccttgagtcaaaataataaatacggatcacttgaggacctccttaacgttcttcgtgctctccacaaagacggtattcaagccattgctgactgggtgccagaccaaatctataacctcccaggaaaagaagtggtaaatgcgacacgtgttaatggttatggtaaccaccaagtaggctaccaaatcattgaccaagcctatgtggctaatactcgtacagatggtacagactatcaaggtaaatacggtggagccttccttgatgagcttaaagctaagtacccatctattttcaaccgtgtgcaaatctcaaatggaaaacagttgcctacgaatgaaaagattactaaatggtctgctaagtacttcaacggaactaatatccttggacgaggtatcaactatgtccttcgtgatgacaagactaaccagtactttaatacttcagccaacagccaactcttgccaacaccacttcgcgatacaggtgccatcacaagcactcaagtcttccaacgtcgtggacaagatgtttatttcctacgtgataaccaagctgttaagaatgaatttgttcaagacggaaacggtaactggtattacttcggtggtgacggtaagatgaccaagggtgcccaaaacatcaataacaaggattactatttctttgacaatggtatccaattgcgtaacgcccttcgtcgtgcttcaaacggctatacctactattacggtctggacggtgccatggttaagaatgccttcgttgattttgatgacaaacataagcaggttcgtgcctttacgactcaaggaacaatggtagtaggtaaccttcattggagtggacaccatttctactttgaccgtgaaacgggtattcaggctaaggatcgcgttgtccgtaccgatgatggcaaattgcattactatgttgctgagacaggtgacatgggacgtaacgtctttgcgacagacagcagcacaggtaaacgttattactttgacgctgacggtaacactgtgactggctcacgtgtcattgatggtaagacttattactttaaccaagatggtagcgtcggtacggcctacagcaatcgtgcagattctattatctttgaaaatggtaaggctcgctacatcacaccagcaggtgaaatcggacgtagcatctttgtctataacccagaaactaaggcttggaactactttgataaagaaggtaaccgtgtcacaggacgccaatacattgatggtcacctttattacttcaaggaagatggtagccaagctaagggtgaaattatcgaagaaaatggcgtcaaatattattatgagccagaatcaggtattcttgcttcaggacgctacctccaagttggtgatgaccagtggatgtacttcaaacaagacggttcactggctatcggccaagttcgtgctgatcatggataccttaagtactttgataaaaatggtatccaagttaaggggaaaactgttgtcgaagatggtaagacttattactatgatgcccacagtggagctcttgtcacaagcagctttgctgagattgcaccaaaccaatggtcttacttcaatactgatggacaagcccttaaaggcaagtggactatcaatggcaaggaatactactttgacgaaaatggtatccaatacaaaggcaaggccattaaggtcggcagtcgttacaagtactatgacgaaaacgacggtcaacctgtaaccaaccgctttgctcaaatcgagcctaacgtctgggcttacttcggagcagatggttatgccgtaacaggcgaacaagtcatcaatggacaacacctttactttgaccaatcaggtcgccaagttaaaggtgcctacgtcacagtcaacggccaacgtcgttactacgatgccaacactggcgaatatgtcccaggaagataa

SEQ ID NO: 110 - protein, 1392 aa, Streptococcus salivarius 57.I
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKKLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSTIDNGYAFDDRYDMALSQNNKYGSLEDLLNVLRALHKDGIQAIADWVPDQIYNLPGKEVVNATRVNGYGNHQVGYQIIDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGGDGKMTKGAQNINNKDYYFFDNGIQLRNALRRASNGYTYYYGLDGAMVKNAFVDFDDKHKQVRAFTTQGTMVVGNLHWSGHHFYFDRETGIQAKDRVVRTDDGKLHYYVAETGDMGRNVFATDSSTGKRYYFDADGNTVTGSRVIDGKTYYFNQDGSVGTAYSNRADSIIFENGKARYITPAGEIGRSIFVYNPETKAWNYFDKEGNRVTGRQYIDGHLYYFKEDGSQAKGEIIEENGVKYYYEPESGILASGRYLQVGDDQWMYFKQDGSLAIGQVRADHGYLKYFDKNGIQVKGKTVVEDGKTYYYDAHSGALVTSSFAEIAPNQWSYFNTDGQALKGKWTINGKEYYFDENGIQYKGKAIKVGSRYKYYDENDGQPVTNRFAQIEPNVWAYFGADGYAVTGEQVINGQHLYFDQSGRQVKGAYVTVNGQRRYYDANTGEYVPGR

SEQ ID NO: 111 - DNA, 4179 bp, Streptococcus sp. ACS2
atcaacggcaaacaatattatgtcaatagtgacggtagtgtgcgtaagaacttcgtttttgagcaagacggtaagtcttattactttgatgctgaaactggggctcttgcgactaagtcacaggatgaattttcaacagaacctatcaaggcaaccgtcgatttttcatctggaaaccagctctacaaaaacgatgacaagtctttagaccaacttgacaccttcatcacagccgatgcttggtatcgtccaaagagcattctcaaggatggtaagacttggacagcttcaactgaagcggacaaacgtcctctattgatggtttggtggcctgacaagtctactcaggttaactaccttaactacatgcaaaatcaaggtcttggagcagggtccttttcaaccaactctagccaggaaagtctggaccaagctgctaaagcagttcagactaagattgaagaacgtatcgctcgtgaaggcaacacaaactggttgcgtacaagtatcgaccagttcatcaagactcagccaggttggaatagtagcactgaaaatagtagctatgaccacttgcaaggtggacagttgctctttaacaacagtaagggtgatactggcaaccgtaccagtcacgccaactctgaccatcgtttgcttaaccgcacaccgactaaccagacgggaacacgtaagtacttcaaggacaattcaatcggtggtcttgagttcttgcttgccaacgatattgataactcaaacccagctgttcaggcagaacaacttaactggctccactttatgatgaatatcggaagtatcatggcgaatgacccaacagctaactttgacggtttgcgtgtcgatgccttggacaatgtggatgccgaccttctccaaatcgcttcagattacttcaaagcagcctatggtgttgacaagtctgaagccaatgcaatcaagcatttgtcatacttggaagcatggtctgccaacgacccatactacaacaaggacactaagggagcacaacttccgattgacaatgcccttcgtaatgctcttaccaacctcttgatgcgtgataaaaatacacgtatgcagcttggggacatgactgctttcatcaacagtagtttgaatccacgtggtgccaacgataaaaacggtgaacgtatggcaaactatattttcacccgtgctcacgatacggaagcccaaacgattattcaacgtattatccgtgatcgtattaacccaaatttgtttggttacaatttcactcgtgatgaaatcaagaaagccttcgagatttacaatgaggatattgataaggctcacaagacttatgcgtcatacaacttgccatctgtctatgctcttatgttgaccaacaaggactctgtaacacgtgtttattacggagacctctatcgtgaagatggtcactacatggctaaaaagacaccgtactttgatgccatcgacaccctcttgcgtgctcgtatcaagtatgtagctggtggtcaagatatggaagtgaagaaagtcggaaatgacggactcttgacatctgttcgttatggtaaaggtgccaataacagaacagatttggggacttctgaaactcgtacgcaaggtatgggtgtcatcatgaccaacaactatgatttccgattgggtagcaatgaaaccgtaacgatgaacatgggtagagctcaccgcaatcagctttatcgcccattgcttttgacgacaaaggatggtatagcaacctacctcaacgattctgatgtacctaaaaaccttctgaaacgtactgactggaatgggaacttgaccttcaatgccaacgatgtttttggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggatgatcaacctgaactctatatgaaccgtgtcttggctaagaacactgacttgctcaaagcatggggaatcacgtcagtcggacttccaccacagtatgtttcaagtaaagatggcactttccttgactcaacgattgacaatggttatgccttcgatgaccgttacgatatggccttgagtcaaaataacaagtacggctcacttgaggacctccttaacgtccttcgtgccctccacaaagacggtattcaagccattgctgactgggtgccagaccaaatctataacctcccaggaaaagaagtggttaatgcgacacgtgttaatggttatggtaaccaccaagtaggctaccaaatcattgaccaagcctatgtggctaatactcgtacagatggtacagactatcaaggtaaatacggtggagccttccttgatgagcttaaagctaagtacccatctattttcaaccgtgtgcaaatctcaaatggtaagcagttgcctacgaatgaaaagattaccaaatggtctgctaagtacttcaatggaactaacatccttggacgaggtatcaactatgtccttcgtgatgacaagaccaaccagtactttaatacttcagccaacagccaactcttgccaacaccacttcgtgatactggtgccatcacaagcactcaaatcttccaacgtcgtggacaagatgtttacttcctacgtgataacaaaactgttaagaatgaatttgttcaagatggtaacggcaactggtattactttggtggtgatggtaagatgaccaagggtgcccaaaacatcaataacaaggattactatttctttgacaatggtatccaattgcgtaacgcccttcgtcgtgcttcaaacggctatacctactattacggtctggacggtgccatggttaagaatgccttcgttgattttgatgacaagcataagcaggtccgtgcctttacgactcaaggaacaatggtagtgggtaaccttcattggagtggacaccatttctactttgaccgtgaaacgggtatccaggctaagggtcgtattgtccgtacagatgatggcaaattgcattactatgttgctgaaactggtgacatgggacgtaacgtctttgcgacagacagcagcacaggtaaacgttattactttgacgctgatggtaacactgtgactggctcacgtgtcattgacggtaagacttattactttaaccaagatggtagtgtcggtacggcctacagcaatcgtgcagattctattatctttgaaaatggtaaggctcgctacatcacaccagcaggcgaaatcggacgtagcatctttgtctacaacccagcaactaaggcatggaactactttgataaagaggggaaccgtgtcacaggacgccaatacattgatggtcacctctattacttcaaggaagatggtagccaagctaagggtgaaattatcgaggaaaacggcattaagtattactatgagccagaatcaggtattcttgcttcaggacgctacctccaagttggtgatgaccagtggatgtacttcaaacaagacggttcactggctatcggccaagttcgtgctgatcatggataccttaagtactttgatgaaaatggtatccaagtcaagggaaaaactgttgtcgaagatggtaagacttattactatgatgctcacagtggagctcttgtaacaagtagctttactgagattgcaccaaaccaatggtcttatttcaatactgaaggtcaagcccttaaaggcaattggactatcaatggcaaggaatactactttgaccaaaatgggattcagtacaagggcaaggccgttaaggtcggcagtcgttacaagtactatgacgaaaacgatggacaacctgtaaccaaccgcttcgctcaaatcgagcctaacgtctgggcttactttggagcagatggttatgctgtgacaggggaacaagtcatcaatggacaacacctttactttgaccaatcaggtcgccaagttaaaggtgcctacgtcacagtcaatggacaacgtcgttactacgatgccaacactggtgaatatgtcccaggaagataa

SEQ ID NO: 112 - protein, 1392 aa, Streptococcus sp. ACS2
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDHRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKNLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSTIDNGYAFDDRYDMALSQNNKYGSLEDLLNVLRALHKDGIQAIADWVPDQIYNLPGKEVVNATRVNGYGNHQVGYQIIDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQIFQRRGQDVYFLRDNKTVKNEFVQDGNGNWYYFGGDGKMTKGAQNINNKDYYFFDNGIQLRNALRRASNGYTYYYGLDGAMVKNAFVDFDDKHKQVRAFTTQGTMVVGNLHWSGHHFYFDRETGIQAKGRIVRTDDGKLHYYVAETGDMGRNVFATDSSTGKRYYFDADGNTVTGSRVIDGKTYYFNQDGSVGTAYSNRADSIIFENGKARYITPAGEIGRSIFVYNPATKAWNYFDKEGNRVTGRQYIDGHLYYFKEDGSQAKGEIIEENGIKYYYEPESGILASGRYLQVGDDQWMYFKQDGSLAIGQVRADHGYLKYFDENGIQVKGKTVVEDGKTYYYDAHSGALVTSSFTEIAPNQWSYFNTEGQALKGNWTINGKEYYFDQNGIQYKGKAVKVGSRYKYYDENDGQPVTNRFAQIEPNVWAYFGADGYAVTGEQVINGQHLYFDQSGRQVKGAYVTVNGQRRYYDANTGEYVPGR

SEQ ID NO: 113 - DNA, 3396 bp, Streptococcus salivarius PS4
cgtccattgctgactgtttggtggccgagcaaggctatccaagccagctacctcaactacatgagagaagaaggtttgggaacaaaccaaacctttacctcatatagttcacagacacagatggaccaagcagcccttgaagtgcaaaaacgtattgaagaacgtattgcgcgtgaagggaacacggactggttgcgcacaactatcaaaaattttgtcaaaacacaaccaggttggaactcaacttctgaaaaccttgataacagcgaccacttgcaaggtggtgcccttctttacaacaacagtaatcgcacaagttatgctaattcagactatcgcctcttgaatcgcacaccgacgcaacaagatggcacacgtcgctactttaaagataattcatcaggtggttttgaatttcttctagcaaacgatattgataactcaaacccagccgttcaagctgaacaattgaactggcttcactatatcatgaacattggtacccttacaggtggtaattctgatgaaaacttcgatggtgttcgtgttgatgctgtggataatgttaacgctgaccttctccaaattgcttcagattatttcaaagctaaatacggcgttgaaaagagtgaagaggaagctattaagcacctttcaatccttgaagcatggtctcataatgatgcatactacaatgaagatactaagggtgctcaattaccgatggatgatccattgcgtttagccatggtattttctttcctacgcccaattggaaaccgttcaggtcttgaaccacttattaccaatagtctgaatgaccgttcagaaagtaagaaaaatacaaaacgtatggcaaactatacttttgttcgtgcccacgactcagaagttcaatcagttattggacaaatcatcaaaaatgaaatcaacccacaatcaactgggaataccttcactcttgatgaaatgaagaaggccttcgaaatctacaatgcagatatgcgaagcgccaataagagatatacacagtacaatatcccatctgcttatgccttcatgttaacgaataaggacactgttcctcgtgtttattatggtgatttgtatactgatgacggtcaatacatggcccaaaaatcaccatatcatgatgctatttctacgctcttgcaagctcgtattcgttatgcggctggtggtcaagacatgaagatgagctacgtaggttcaggaaataccaatggttgggatgcttcaggtatcttaacatcagtccgttatggtaaaggagctaacaacgcttcagatgctggtactgctgaaactcgtaaccaagggatggctgtcattctttccaaccaacctgcccttcgtttgaatagcaatttgacaatcaacatgggtgcagctcacagaaaccaagcctatcgtccattgcttttgacaacctctaatggtgttgcctcttacttgaatgatggcgatgctaacggtattgttaagtatactgatggcaacggtaatttgaccttcaatccaggtgaaatcagtggtgttcgtaatgctcaagttgatggctatttagccgtttgggtaccattaggtgcttctgaaaatcaagacgtgcgtgtggcagcaagcaaatctaagaatagcagtggtttggtctatgattcttcagctgccttggattcacaagttatctacgaaggcttctcaaacttccaagacttcgtccaagacccatcacaatacactaacaagaagattgctgaaaatgctaacctcttcaagaaatggggaatcacatcattcgaatttgctccacaatacgtttcaagtgatgacggtaccttccttgactcagttattcaaaatggttatgccttctcagaccgttatgacattggtatgagtaaggacaacaagtatggttcattagcagacttgaaagcagcgcttaagtcactccacgctgtaggtatctcagccattgctgactgggttccagaccaaatctacaaccttccgggtgatgaagtggtcactgcaactcgtgttaataactacggagaaactaaagacggtgctatcatcgaccatagcctttatgttgctaaaacacgtacctttggtaacgactaccaaggtaaatatggtggtgcctaccttgacgaattaaaacgtctttacccacaaatctttgaccgtgttcaaatctctactggtaaacgcttgacaaccgatgagaagattacaaaatggtctgctaaatatatgaatggtaccaatattcttgaccgtggatcagagtatgtcctcaagaatggtcttagcggttactatggaaccaatggtggtaaagttagccttccaaaagtagtaggaagcaaccaatcaacgaacaataacaaccaaaatggtgatggtagcggtaggttcgaaaagagctggggcagcgtttactatcgttacaacgatggtcaacgtgctagaaatgcctttatcaaagataatgatggcaatgtttactactttgataacacaggccgtatggcaatcggtgaaaagactatcgatggcaaacaatacttcttcctcgctaatggggtgcaattgcgtgatggctatcgtcaaaaccgtagaggtcaagtcttctactatgatgaaaatggtatcatgagtcaaaccggtaaaccaagtccaaaaccagaaccaaaaccagataataatatctctagccgtaaccaatttgtccaaatcggtaacaacgtttgggcatactatgatggtaatggtaaacgtgtgactggtcatcaaaacatcaacggtcaagaactcttctttgataacaatggtgttcaagtcaaaggtcgtacagcccaggttgatggtgttactcgttactttgatgccaattcaggtgaaatggcacgcaaccgattcgctgaagttgaaccaggtgtttgggcatactttaacaatgatggagctgccgtaacaggttcacaaaacatcaatggtcaaaccctctactttgatcataatggtcatcaagtcaaaggagctttggtaactgttaatggcaaccttcgctactatgatgccaactcaggagatctttatcgtaatcgtttccaagaagttaatggtagctggtattactttgatggtaatggtaatgcggtcaaaggcatggtcaacatcaatggtcaaaacctcctctttgataatgatggaaaacaagtcaaaggtcatttggtccgtgtaaatggtgtcattcgttattatgatccaaattcaggtgaaatggcagttaatcgttgggttgaaatcagctcaggatggtgggtttactttgatggtgaaggtcgaggccaaatccaaatctaa

SEQ ID NO: 114 - protein, 1131 aa, Streptococcus salivarius PS4
RPLLTVWWPSKAIQASYLNYMREEGLGTNQTFTSYSSQTQMDQAALEVQKRIEERIAREGNTDWLRTTIKNFVKTQPGWNSTSENLDNSDHLQGGALLYNNSNRTSYANSDYRLLNRTPTQQDGTRRYFKDNSSGGFEFLLANDIDNSNPAVQAEQLNWLHYIMNIGTLTGGNSDENFDGVRVDAVDNVNADLLQIASDYFKAKYGVEKSEEEAIKHLSILEAWSHNDAYYNEDTKGAQLPMDDPLRLAMVFSFLRPIGNRSGLEPLITNSLNDRSESKKNTKRMANYTFVRAHDSEVQSVIGQIIKNEINPQSTGNTFTLDEMKKAFEIYNADMRSANKRYTQYNIPSAYAFMLTNKDTVPRVYYGDLYTDDGQYMAQKSPYHDAISTLLQARIRYAAGGQDMKMSYVGSGNTNGWDASGILTSVRYGKGANNASDAGTAETRNQGMAVILSNQPALRLNSNLTINMGAAHRNQAYRPLLLTTSNGVASYLNDGDANGIVKYTDGNGNLTFNPGEISGVRNAQVDGYLAVWVPLGASENQDVRVAASKSKNSSGLVYDSSAALDSQVIYEGFSNFQDFVQDPSQYTNKKIAENANLFKKWGITSFEFAPQYVSSDDGTFLDSVIQNGYAFSDRYDIGMSKDNKYGSLADLKAALKSLHAVGISAIADWVPDQIYNLPGDEVVTATRVNNYGETKDGAIIDHSLYVAKTRTFGNDYQGKYGGAYLDELKRLYPQIFDRVQISTGKRLTTDEKITKWSAKYMNGTNILDRGSEYVLKNGLSGYYGTNGGKVSLPKVVGSNQSTNNNNQNGDGSGRFEKSWGSVYYRYNDGQRARNAFIKDNDGNVYYFDNTGRMAIGEKTIDGKQYFFLANGVQLRDGYRQNRRGQVFYYDENGIMSQTGKPSPKPEPKPDNNISSRNQFVQIGNNVWAYYDGNGKRVTGHQNINGQELFFDNNGVQVKGRTAQVDGVTRYFDANSGEMARNRFAEVEPGVWAYFNNDGAAVTGSQNINGQTLYFDHNGHQVKGALVTVNGNLRYYDANSGDLYRNRFQEVNGSWYYFDGNGNAVKGMVNINGQNLLFDNDGKQVKGHLVRVNGVIRYYDPNSGEMAVNRWVEISSGWWVYFDGEGRGQIQI

SEQ ID NO: 115 - DNA, 3939 bp, Streptococcus mutans JP9-4
attgatggtaagtattattattatgacaataacggcaaagttcgtactaattttacattaattgctgatggcaaaattttacattttgatgaaactggcgcttatactgatacatcaattgacactgtaaataaagatatcgtcacaacaagaagtaatctatacaaaaaatataatcaagtttatgatcgctctgcacagagctttgagcatgttgatcattatttgacagctgagagttggtatcgtcctaagtacatcttgaaggatggcaaaacatggacacagtcaacagaaaaagatttccgtcccttattgatgacatggtggcctgaccaagaaacgcagcgtcaatatgttaactacatgaatgcacagcttggcattaacaagacttatgatgatacaagtaatcaattgcaattaaatattgcagctgcaactattcaagcaaaaattgaggccaaaattacaactttaaagaatactgattggctgcgtcagactatttccgcatttgttaagacacagtcagcttggaacagtgacagcgaaaaaccgtttgatgatcatttacaaaatggagcagtgctttacgataatgaaggaaaattaacgccttatgctaattccaactaccgtatcttaaatcgcaccccgaccaatcaaaccggaaagaaagatccaaggtatacagctgataacactatcggcggttatgaatttcttttggcaaacgatgtggataattctaatcctgtcgtgcaggccgaacaattgaactggctacattttctcatgaactttggtaacatttatgccaatgatccggatgctaactttgattccattcgtgttgatgcggtagataatgtggatgctgacttgctccaaattgctggggattacctcaaagctgctaaggggattcataaaaatgataaagctgctaatgatcatttgtctattttagaggcatggagtgacaacgacactccttaccttcatgatgatggcgacaatatgattaatatggataataagctgcgtttgtctctattattttcattagctaaacccttaaatcaacgttcaggcatgaatcctctcatcactaacagtttggtgaatcgaactgatgataatgctgaaactgccgcagtcccttcttattccttcatccgtgcccatgacagtgaagtgcaggatttgattcgtgatatcatcaaggcagaaatcaatcctaatgttgtcgggtattcattcactatggaggaaatcaagaaggctttcgagatttacaacaaagacttattagctacagagaagaaatacacacactataatacggcactttcttatgccctgcttttaaccaacaaatccagtgtgccgcgtgtctattatggggatatgtttacagatgacgggcaatacatggctcataagacgatcaattacgaagccatcgaaaccctgcttaaagctcgtattaagtatgtttcaggcggtcaagccatgcgcaatcaacaggttggcaattctgaaatcattacgtctgtccgctatggtaaaggtgctttgaaagcaacggatacaggggaccgcaccacacggacttcaggagtggccgtgattgaaggcaataacccttctttacgtttgaaggcttctgatcgcgtggttgtcaatatgggagcagcccataagaaccaagcataccgacctttactcttgaccacagataacggtatcaaggcttatcattccgatcaagaagcggctggtttggtgcgctacaccaatgacagaggggaattgatcttcacagcggctgatattaaaggctatgccaaccctcaagtttctggctatttaggtgtctgggttccagtaggcgctgccgctgatcaagatgttcgcgttgcggcttcaacggccccatcaacagatggcaagtctgtgcatcaaaatgcggcccttgattcacgcgtcatgtttgaaggtttctctaatttccaagcattcgccactaaaaaagaggaatataccaatgttgtggttgctaagaatgtggataagtttgcggaatggggggtcacagactttgaaatggcaccgcagtatgtgtcttcaacggatggttctttcttggattctgtgatccaaaacggctatgcttttacggaccgttatgatttgggaatttccaaacctaataaatacgggacagccgatgatttggtgaaagccatcaaagcgttacacagcaagggcattaaggtaatggctgactgggtgcctgatcaaatgtatgctttccctgaaaaagaagtggtaactgcaacccgtgttgataagtatgggactcctgttgcaggaagtcagatcaaaaacaccctttatgtagttgatggtaagagttctggtaaagatcaacaagccaagtatgggggagctttcttagaggagctgcaagcgaagtatccggagctttttgcgagaaaacaaatttccacaggggttccgatggacccttctgttaagattaagcaatggtctgccaagtactttaatgggacaaatattttagggcgcggagcaggctatgtcttaaaagatcaggcaactaatacttactttaatatttcagataataaagaaataaacttccttcctaaaacattgttaaaccaagatagtcaagttggtttctcttatgacggtaaaggttatgtttattattcaacgagtggttaccaagccaaaaatactttcatcagcgaaggtgataaatggtattattttgataataacggttatatggtcactggtgctcaatcaattaacggtgttaattattatttcttatcaaatggcctacagctcagagatgctattcttaagaatgaagatggaacttacgcttattatggaaatgacggtcgccgttatgaaaatggttattatcaattcatgagtggtgtatggcgtcacttcaataatggtgaaatgagtgttggattaactgtaattgatggtcaggttcaatactttgatgaaatgggctatcaagccaaaggaaaatttgtaacaactgccgatggtaaaataagatattttgataagcaatctgggaacatgtaccgtaatcgttttattgaaaacgaagaaggtaaatggctgtatctcggtgaagatggtgcagcagtgacaggatctcaaaccattaacggtcaacacctgtactttagagcaaacggtgttcaggtcaagggtgaatttgtcactgaccaccacggccgtatcagctattacgacggcaattcaggggatcaaatccgcaaccgctttgtccgcaatgctcagggtcaatggttctactttgataacaatggctatgccgtaaccggtgccagaaccattaacggtcaacacctatactttagagcaaacggtgttcaggtcaagggtgaatttgtcactgaccgctacggccgtatcagctattacgacggcaattcaggggatcaaatccgcaaccgctttgtccgcaatgctcagggtcaatggttctactttgataacaatggctatgccgtaaccggtgccagaaccattaacggtcaacacctatactttagagcaaacggtgttcaggtcaagggtgaatttgtcactgaccgccacggccgtatcagctattacgacggcaattcaggggatcaaatccgcaaccgctttgtccgcaatgctcagggtcaatggttctactttgataacaatggctatgccgtaaccggtgccagaaccattaacggtcaacacctatactttagagcaaacggtgttcaggtcaagggtgaatttgtcactgaccgctacggccgtatcagttattacgatgctaactctggagaacgagttcggattaactaa

SEQ ID NO: 116 - protein, 1312 aa, Streptococcus mutans JP9-4
IDGKYYYYDNNGKVRTNFTLIADGKILHFDETGAYTDTSIDTVNKDIVTTRSNLYKKYNQVYDRSAQSFEHVDHYLTAESWYRPKYILKDGKTWTQSTEKDFRPLLMTWWPDQETQRQYVNYMNAQLGINKTYDDTSNQLQLNIAAATIQAKIEAKITTLKNTDWLRQTISAFVKTQSAWNSDSEKPFDDHLQNGAVLYDNEGKLTPYANSNYRILNRTPTNQTGKKDPRYTADNTIGGYEFLLANDVDNSNPVVQAEQLNWLHFLMNFGNIYANDPDANFDSIRVDAVDNVDADLLQIAGDYLKAAKGIHKNDKAANDHLSILEAWSDNDTPYLHDDGDNMINMDNKLRLSLLFSLAKPLNQRSGMNPLITNSLVNRTDDNAETAAVPSYSFIRAHDSEVQDLIRDIIKAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKATDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVVAKNVDKFAEWGVTDFEMAPQYVSSTDGSFLDSVIQNGYAFTDRYDLGISKPNKYGTADDLVKAIKALHSKGIKVMADWVPDQMYAFPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFNISDNKEINFLPKTLLNQDSQVGFSYDGKGYVYYSTSGYQAKNTFISEGDKWYYFDNNGYMVTGAQSINGVNYYFLSNGLQLRDAILKNEDGTYAYYGNDGRRYENGYYQFMSGVWRHFNNGEMSVGLTVIDGQVQYFDEMGYQAKGKFVTTADGKIRYFDKQSGNMYRNRFIENEEGKWLYLGEDGAAVTGSQTINGQHLYFRANGVQVKGEFVTDHHGRISYYDGNSGDQIRNRFVRNAQGQWFYFDNNGYAVTGARTINGQHLYFRANGVQVKGEFVTDRYGRISYYDGNSGDQIRNRFVRNAQGQWFYFDNNGYAVTGARTINGQHLYFRANGVQVKGEFVTDRHGRISYYDGNSGDQIRNRFVRNAQGQWFYFDNNGYAVTGARTINGQHLYFRANGVQVKGEFVTDRYGRISYYDANSGERVRIN

SEQ ID NO: 117 - DNA, 3021 bp, artificial sequence
  T5 C-terminal truncation of GTF0974
attaacggcaaacaatactatgtcaatagtgacggtagtgtacgtaaaaacttcgtttttgagcaagatggtaagtcttattactttgatgctgaaacaggggcacttgcgactaagtctcaggatgaattttcaacagaacctatcaaggcaaccgtagatttttcatctggaaaccagctctacaaaaacgatgacaagtctttggaccaactcgacaccttcatcacagcggatgcttggtaccgtccaaagagcattctcaaggatggtaagacttggacagcttcaactgaagcggacaaacgtcctctattgatggtttggtggcctgacaagtctactcaggtcaactaccttaactacatgcaaaatcaaggtcttggagcagggtcattttcaaccaactctagtcaggaaagtctggaccaagctgctaaagcggttcagactaagattgaagaacgtatcgcgcgtgagggcaataccaactggttacgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgacaaaccaaacgggtacacgtaagtacttcaaggacaattctatcggtggtcttgagttcttgcttgccaacgatattgataactcaaacccagctgttcaggcagaacaacttaactggctccactttatgatgaatatcggaagtatcatggcaaatgacccaactgccaactttgacggtttgcgtgtcgacgccttggacaatgtggatgccgaccttctccaaatcgcttcagattactttaaagcagcctatggggttgacaagtctgaagccaatgctattaagcacttgtcatatttggaagcatggtctgccaacgacccatactacaacaaggacactaagggagcacaacttccgattgataatgcccttcgtaacgcccttaccaacctcttgatgcgtgataaaaatacacgtatgcagcttggggacatgactgccttcatcaatagtagtttgaatccacgtggtgccaacgataaaaacggtgaacgtatggctaactatattttcactcgtgcccatgatacagaagctcaaacgattattcaacgtatcatccgtgatcgtattaacccaaatttatttggttacaatttcactcgtgatgaaatcaagaaagccttcgagatttacaatgaggatattgataaggctcacaagacttatgcgtcatacaacttaccatctgtctatgccctcatgttgaccaacaaggactctgtaacacgtgtttattacggagacctctatcgtgaagatggtcactacatggctaaaaagacaccgtactttgatgccatcgacaccctcttgcgtgctcgcatcaagtatgtagctggtggtcaagacatggaagtgaagaaagtcggaaatgatggactcttgacatctgttcgttatggtaaaggtgccaataacagaactgatttgggaacttctgaaacccgtacgcaagggatgggtgtcatcatgaccaacaactatgatttccgcttgggtagcaatgaaaccgtaacgatgaacatgggtagagctcaccgtaatcagctttatcgcccattgcttttgacgacaaaggatggtatagcaacctacctcaacgattctgatgtgcctaaaaaacttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaacaattgataatggttatgcctttgatgaccgttacgatatggccttgagtcaaaataataaatacggatcacttgaggacctccttaacgttcttcgtgctctccacaaagacggtattcaagccattgctgactgggtgccagaccaaatctataacctcccaggaaaagaagtggtaaatgcgacacgtgttaatggttatggtaaccaccaagtaggctaccaaatcattgaccaagcctatgtggctaatactcgtacagatggtacagactatcaaggtaaatacggtggagccttccttgatgagcttaaagctaagtacccatctattttcaaccgtgtgcaaatctcaaatggaaaacagttgcctacgaatgaaaagattactaaatggtctgctaagtacttcaacggaactaatatccttggacgaggtatcaactatgtccttcgtgatgacaagactaaccagtactttaatacttcagccaacagccaactcttgccaacaccacttcgcgatacaggtgccatcacaagcactcaagtcttccaacgtcgtggacaagatgtttatttcctacgtgataaccaagctgttaagaatgaatttgttcaagacggaaacggtaactggtattacttcggtggtgacggtaagatgaccaagggtgcccaaaacatcaataacaaggattactatttctttgacaatggtatccaattgcgtaacgcccttcgtcgtgcttcaaacggctatacctactattacggtctggacggtgccatggttaagaatgccttcgttgattttgatgacaaacataagcagtaa

SEQ ID NO: 118 - protein, 1006 aa, artificial sequence
  T5 C-terminal truncation of GTF0974
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKKLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSTIDNGYAFDDRYDMALSQNNKYGSLEDLLNVLRALHKDGIQAIADWVPDQIYNLPGKEVVNATRVNGYGNHQVGYQIIDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGGDGKMTKGAQNINNKDYYFFDNGIQLRNALRRASNGYTYYYGLDGAMVKNAFVDFDDKHKQ

SEQ ID NO: 119 - DNA, 3021 bp, artificial sequence
  T5 C-terminal truncation of GTF4336
attaacggcaaacaatactatgtcaatagtgacggtagtgtgcgtaagaactttgtctttgagcaagatggtaagtcttattactttgatgctgaaacaggggctcttgcgactaagtcacaggatgaattttcaacagaaccaatcaaggcaaccgtcgatttttcatctggaaaccagctctacaaaaacgatgataaatcgttggaccagctcgataccttcatcacagcggatgcttggtaccgtccaaagagcattctcaaggatggtaagacttggacggcttcaactgaggctgacaaacgtccactcttgatggtttggtggcctgacaagtcaactcaggttaactaccttaactacatgcaaaatcaaggtcttggtgcaggctcattttcaaccaactctagccaggaaagtctggaccaagctgctaaagcggttcagactaagattgaagaacgtatcgctcgtgaaggcaacacaaactggttgcgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgactaaccagacgggtacacgtaagtacttcaaggacaattctatcggtggtcttgagttcttgcttgccaacgatattgataactcaaacccagctgttcaggcagagcaacttaactggctccactttatgatgaatattggaagcatcatggcaaatgacccaacagctaactttgacggtttgcgtgtcgatgccttggacaatgtggatgctgaccttctccaaatcgcatcagactacttcaaagcagcctatggtgttgacaagtctgaagccaatgccattaagcacttgtcatacttggaagcatggtctgccaacgacccatactacaataaggacactaagggggcacaacttccgattgacaatgccctccgtaatgcccttaccaacctcttgatgcgtgataagaatacacgtatgcagcttggggacatgactgccttcatcaacagtagtttgaatccacgtggtgccaacgataaaaacggtgaacgtatggcaaactatattttcacccgtgctcacgatacggaagctcaaacgattattcaacgtatcatccgtgatcgtatcaacccaaatttgtttggttacaatttcactcgtgatgaaatcaagaaagccttcgagatttacaatgaggatattgataaggctcacaagacttatgcgtcatacaacttaccatctgtttatgctctcatgttgaccaacaaggactctgtaacacgagtttattacggagacctctaccgtgaagatggtcactacatggctaaaaagacaccgtactttgatgccattgacaccctcttgcgtgctcgtatcaagtatgtagctggtggtcaagacatggaagtgaagaaagtcggaaatgacggcctcttgacatctgttcgttatggtaaaggtgccaataacagaacagatttgggaacttcagaaactcgtacgcaaggtatgggtgtcatcatgaccaacaactatgatttccgcttgggtagcaatgaaactgtaacgatgaacatgggtagagcacaccgtaatcagctttatcgcccattgcttttgacgacaaaggatggtatagcaacctacttcaacgattctgatgtgcctaaaaaccttctgaaacgtactgactggaatgggaacttgaccttcaatgccaatgatgtttttggtgtggaaaatgtccaagtatcaggttaccttggtgtctgggtaccagtcggggctaaggctaaccaagacgcacgtacacagccaagtaaccgtgccaatagcgatggtcaagtttacaagtcttcagcagcccttgattcgcaagtcatgtatgaagccttctcaaacttccaagcatttgcggacgatcagccagaactctacatgaaccgtgtcttggctaagaacactgacttgctcaaagcatggggtgttacgtctgttggacttccaccacagtacgtttcaagtaaggatggtaccttccttgattcaacaattgacaatggttatgcctttgatgaccgttatgacatggccttgagtcaaaataacaagtatggctcacttgaggacctccttaatgttcttcgtgccctccacaaagatggtattcaagccattgctgactgggtgccagaccaaatttataaccttccaggaaaagaagtagttaatgccacacgtgttaacggctacggttatcaccaacaaggttatcaaattgtggaccaagcctatgtggcaaatacccgtacagatggtacagactatcaaggtaaatacggtggagccttccttgatgagcttaaagctaagtacccatctattttcaaccgtgtgcaaatctcaaatggtaagcagttacctacgaatgaaaagattactaaatggtctgctaagtacttcaacggaactaatatccttggacgaggtatcaactatgtccttcgtgatgacaagaccaaccagtactttaatacctcagctaacagccaactcttgccaacaccacttcgtgacacaggtgccattacaagcactcaagtcttccaacgtcgtggacaagatgtttacttccttcgtgataaccaagccgttaagaatgaatttgttcaagacggtaacggcaactggtattacttcggtgctgacggtaagatgaccaagggtgctcaaaccatcaataaaaaggattactatttctttgacaatggtatccaattgcgtaacgcccttcgtcgtgctaacaacggttatacttactattacggtttagacggtgctatggttaagaatgcctttgttgattttgacgacaagcgtaagcagtaa

SEQ ID NO: 120 - protein, 1006 aa, artificial sequence
  T5 C-terminal truncation of GTF4336
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYFNDSDVPKNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGADGKMTKGAQTINKKDYYFFDNGIQLRNALRRANNGYTYYYGLDGAMVKNAFVDFDDKRKQ

SEQ ID NO: 121 - DNA, 3021 bp, artificial sequence
  T5 C-terminal truncation of GTF4491
atcaacggcaaacaatactatgtcaatagtgacggtagtgtgcgtaagaactttgtttttgagcaagatggtaagtcttattactttgatgctgaaacaggggctcttgcgactaagtcacaggatgaattttcaacagaacctatcaaggcaaccgtagatttttcatctggtaaccagctctacaaaaacgatgacaaatctttggaccaacttgacaccttcatcacagcggatgcttggtaccgtccaaagagcattctcaaggatggtaagacttggacagcttcaactgaagctgacaaacgtcctctcttgatggtttggtggcctgacaagtctactcaggtcaactaccttaactacatgcaaaatcaaggtcttggtgcagggtcattttcaaccaactctagccaggaaagtctggaccaagctgctaaagcggttcagactaagattgaagaacgtatcgcgcgtgagggcaataccaactggttgcgtacaagtatcgaccagttcatcaagacacagccaggttggaatagtagcactgaaaatagttcatacgaccacttgcaaggcggacagttgctctttaacaacagtaagggtgatactggcaaccgtaccagccacgccaactctgactatcgtttgttaaaccgcacaccgactaaccagacgggtacacgtaagtacttcaaggataattctatcggtggtcttgagttcttgcttgccaacgatattgataactcaaacccagctgttcaggcagagcaacttaactggctccactttatgatgaatatcggaagcatcatggctaatgacccaactgccaactttgacggtttgcgtgtcgatgccttggacaatgtggatgccgacctgctccaaatcgcatcagactacttcaaagcagcctatggtgttgacaagtctgaagccaatgccatcaagcacttgtcatacttggaagcatggtctgccaacgacccatactacaacaaggacactaagggagcacaacttccgattgacaatgcccttcgtaatgccctcaccaacctcttgatgcgtgataaaaatacacgtatgcagcttggagacatgactgctttcatcaacagtagtttgaacccacgaggtgccaacgataaaaacggtgaacgtatggcaaactatattttcacccgtgcccatgatacagaagctcaaaccattattcaacgtatcattcgtgatcgtattaacccaaatttgtttggttataatttcacacgtgatgaaatcaagaaagccttcgagatttacaatgaggatattgataaggctcacaagacttatgcgtcatacaacttgccatctgtctatgccctcatgttgaccaataaggactctgtaacacgtgtttattacggagacctctaccgtgaagatggtcactacatggctaagaagacgccttactttgatgccatcgacaccctcttgcgtgcccgtatcaagtatgtagctggtggtcaagacatggaagtgaagaaagtcggaaatgacggcctcttgacatcagttcgttatggtaaaggtgccaataacagaactgatttgggaacttctgaaactcgtacgcaaggtatgggtgtcatcatgaccaacaactatgatttccgcttgggtagcaatgaaactgtaacgatgaacatgggtagagctcaccgtaatcagctttatcgaccattgcttttgacgacaaaggatggtatagcaacctacctcaacgattctgatgtgcctaaaaaccttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaataattgataatggttatgcctttgatgaccgttacgatatggccttgagtcaaaataataaatacggatcacttgaggacctccttaacgttcttcgtgccctccataaagacggtattcaagccattgctgactgggtaccagaccaaatctataacctcccaggaaaagaagtggtaaatgcgacacgtgttaacggctacggttatcaccaacaaggttatcaaattgtggaccaagcctatgtggcaaatacccgtacagatggtacagactatcaaggcaagtacggtggtgccttccttgatgagctgaaagctaagtacccatctattttcaaccgtgtgcaaatctcaaatggtaagcaattgcctacgaatgaaaagattacaaaatggtctgctaagtacttcaacggaaccaacatccttggacgaggcatcaactttgtccttcgtgatgacaagaccaaccagtactttaatacttcagctaacagccaactcttgccaacaccacttcgtgatacgggtgccatcacaagcactcaagtcttccaacgtcgtggacaagatgtttacttccttcgcgataaccaaaccgttaagaatgaatttgttcaagacggtaacggtaactggtattacttcggtggtgacggtaagatgaccaagggtgcccaaaacatcaatagcaaggattactatttctttgataatggtgttcaattgcgtaatgccctgcgtcgtgcttcaaacggctatacttactattacggtctggacggtgctatggttaagaatgccttcgttgattttgatgacaagcataagcagtaa

SEQ ID NO: 122 - protein, 1006 aa, artificial sequence
  T5 C-terminal truncation of GTF4491
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKNLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSIIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINFVLRDDKTNQYFNTSANSQLLPTPLRDTGAITSTQVFQRRGQDVYFLRDNQTVKNEFVQDGNGNWYYFGGDGKMTKGAQNINSKDYYFFDNGVQLRNALRRASNGYTYYYGLDGAMVKNAFVDFDDKHKQ

SEQ ID NO: 123 - DNA, 3021 bp, artificial sequence
  T5 C-terminal truncation of GTF3808
attaacggcaaacaatactatgtcaatagtgacggtagtgtgcgtaagaactttgtctttgagcaagatggtaagtcttattactttgatgctgaaacaggggctcttgcgaccaagtcacaggatgaattttcaacagaacctatcaaggcaaccgtagatttttcatctggaaaccagctctacaaaaacgatgacaagtctttggaccaactcgacaccttcatcacagcggatgcttggtaccgtccaaagagcattctcaaggatggtaagacttggacagcttcaactgaagcggacaaacgtccactcttgatggtttggtggcctgacaagtcaactcaggttaactacctcaactatatgcaaaatcaaggtcttggtgcaggctcattctcaaccaactctagccaggaatcactagaccaagctgccaagatggttcagactaagattgaagaacgtatcgctcgtgaaggaaacacaaactggttgcgtacaagtatcgaccagttcatcaagactcagccaggttggaatagtagcactgaaaatagttcatacgaccacttgcaaggtggacagttgctctttaacaacagtaagggtgatactggcaaccgtacgagtcacgccaactctgactatcgtttgcttaaccgcacaccgactaaccagacgggtacgcgtaagtacttcaaggacaattctatcggtggtcttgagttcttgcttgccaacgatattgataactcaaacccagcagttcaggcagagcaacttaactggcttcactttatgatgaatatcggaagcatcatggcgaatgacccaacagcaaactttgacggtttgcgtgtcgatgccttggacaatgtggatgccgaccttctccaaatcgcttcagattacttcaaagcagcctatggtgtggacaagtctgaagccaatgccattaagcacttgtcatacttggaagcatggtctgccaacgacccatactataacaaggacactaagggggcacaacttccgattgataatgcccttcgtaatgcccttaccaacctcttgatgcgtgataaaaatacacgtatgcagcttggggacatgactgctttcatcaacagtagtttgaatccacgtggtgctaacgataaaaatggtgaacgtatggctaactatattttcacccgtgcccacgatacggaagctcaaacgattatccaacgtatcatccgtgatcgtatcaatccaaatttgtttggctacaatttcactcgtgatgaaatcaagaaagccttcgagatttacaatgaggatattgataaggctcacaagacttatgcgtcatacaacttgccatctgtttatgctctcatgttgaccaacaaggactctgtaacacgtgtttattacggagacctctatcgtgaggatggtcactacatggctaaaaagacgccttactttgatgccatcgacaccctcttgcgtgctcgtatcaagtatgtagctggtggtcaagacatggaagtgaagaaagtcggaaatgatggcctcttgacatctgttcgttatggtaaaggtgccaataacagaactgatttgggaacttcagaaactcgtacgcaaggtatgggtgtcatcatgaccaacaactatgatttccgcttgggtagcaatgaaactgtaacgatgaacatgggtagagcacaccgtaatcagctttatcgcccattgcttttgacaacaaaagatggtatagcaacctacctcaacgattctgatgtgcctaaaaaccttcttaaacgcactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcatttgcggacgatcagccagaactctacatgaaccgtgtcttggctaagaacactgacttgctcaaagcatggggaatcacgtcggtcggacttccaccacagtatgtttcaagtaaagatggcactttccttgactcaacaattgataatggttatgcctttgatgaccgttacgatatggccttgagtcaaaataataaatacggatcacttgaggacctccttaacgttcttcgtgccctccataaagacggtattcaagccattgctgactgggtgccagaccaaatctataacctcccaggaaaagaagtggtaaatgcgacacgtgttaatggttatggtaaccaccaagtaggctaccaaatcattgaccaagcctatgtggctaatactcgtacagatggtacagactatcaaggtaaatacggtggtgccttccttgatgagcttaaagctaagtacccatctattttcaaccgtgtgcaaatctcaaatggaaaacagttgcctacgaatgaaaagattactaaatggtctgctaagtacttcaacggaactaatatccttggacgaggtatcaactatgtccttcgtgatgacaagactaaccagtactttaatacttcagccaacagccaactcttgccaacaccacttcgtgatactggtgccatcacaagcactcaagtcttccaacgtcgtggacaagatgtttatttcctacgtgataaccaagctgttaagaatgaatttgttcaagatggtaacggcaactggtattactttggtggtgatggtaagatgaccaagggtgcccaaaacatcaataacaaggattactatttctttgacaatggtatccaattgcgtaacgcccttcgtcgtgcaagcaacggctatacctactattacggtctggacggcgcaatggttaagaatgccttcgttgattttgatgacaaacataagcagtaa

SEQ ID NO: 124 - protein, 1006 aa, artificial sequence
  T5 C-terminal truncation of GTF3808
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKMVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKNLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSTIDNGYAFDDRYDMALSQNNKYGSLEDLLNVLRALHKDGIQAIADWVPDQIYNLPGKEVVNATRVNGYGNHQVGYQIIDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGGDGKMTKGAQNINNKDYYFFDNGIQLRNALRRASNGYTYYYGLDGAMVKNAFVDFDDKHKQ

SEQ ID NO: 125 - DNA, 3018 bp, artificial sequence
  T5 C-terminal truncation of GTF0459
atcaacggcaaacaatactatgtcaatagtgacggtagtgtgcgtaagaacttcgtttttgagcaagatggtaagtcatattactttgatgctgaaacaggggctcttgcgaccaagtcacaggatgaattttcaacagaacctatcaaggcagctgtggatttttcatctggaaatcagctctacaaaaacgataacaaatctttggaccaactcgacaccttcatcactgcggatgcttggtaccgtccaaagagtattctcaaggatggtaagacttggacagcttcaactgaagcggacaaacgtcctctcttgatggtttggtggcctgacaaatcgactcaggttaactaccttaactacatgcaaaatcaaggtcttggtgcgggatcattttcaaccaactctagccaggaaagtctaaatctagctgctaaagcggttcagactaagattgaagaacgtattgcgcgtgaaggcaataccaactggttgcgtacaagtatcgaccagttcatcaagactcagccaggttggaatagtagcactgaaaatagttcttatgaccacttacaaggcggacagttgctctttaacaacagtaagggtgatactggtaaccgtactagctacgccaactctgattatcgtttgcttaaccgcacaccgacaaaccagagtgggacacgtaagtatttcaaggataattctatcggtggtcttgagttcttgcttgccaacgatattgacaactcaaacccagctgttcaggcggagcaacttaactggctccactttatgatgaatattggaagcatcatggccaatgacccaacagccaactttgacggtttgcgtgtcgatgctttggacaatgtggatgccgaccttctccaaatcgcttcagattacttcaaagcagtctatggtgttgacaagtccgaagctaatgcgatcaaacacttgtcatacttggaagcgtggtctgccaacgacccatactacaacaaggatactaagggggcacaactgccgattgataatgcccttcgtaatgctcttaccaaccttttgatgcgtgataaaaatacacgtatgcagcttggggacatgactgcttttatgaatagtagtttgaatccacgtggtgctaacgataagaacggtgaacgtatggctaactatattttcacccgtgcccacgatactgaagcgcaaaccattatccaacgtatcatccgtgatcgtatcaacccaaatctgtttggttacaatttcacccgtgatgaaatcaagaaggctttcgagatttacaatgcggatatcaatacagctcacaagacttatgcgtcatacaacttgccatctgtctatgccctcatgttgaccaacaaggactctgtgacacgtgtttattatggagacctctaccgtgaagacggtcactacatggccaagaagacgccttactttgatgccatcgatacccttttgcgtgcccgtatcaagtatgtggccggtggtcaagacatggaagtgaagaaagtcggaaatgatggacttttgacttctgttcgttatggtaagggtgccaataacagcactgattggggaactactgaaacccgtacgcaagggatgggtgtcattttgaccaataactacgatttccgcttgggtagcaatgaaactgtaacgatgaatatgggtagagcccaccgtaatcagctttaccgtccattgcttttgacgactaaggatggtctagcaacctacctcaacgattctgatgtaccttcaaaccttcttaaacgtaccgactggaatgggaatttgaccttcaatgccaacgatgtttttggtgtggaaaatgtgcaagtatcaggttacctcggtgtctgggtaccagtcggggctaaggctaaccaagacgcacgtacacagccaagtaaccgtgccaatagtgatggtcaagtttacaagtcttcagcagcccttgattcgcaagttatgtatgaagccttctcaaacttccaagcgtttgcggacgatcagccagaactctacatgaaccgtgtcttggctaagaacactgacttgctcaaagcgtggggtgttacatctgttggacttccaccacagtacgtttcaagtaaggatggtaccttcctcgattcaacgattgacaatggttatgcctttgatgaccgttatgacatggccttgagtcaaaataataaatatggctcacttgaggacctccttaacgtccttcgtgccctccacaaagatggtattcaagccattgctgactgggtgccagaccaaatctataaccttccaggtaaggaagtggtgaatgccacacgtgttaacggctacggttatcaccaacaaggttatcaaattgtggaccaagcctatgtggcaaatacccgtacagatggtacagactatcaaggtagatacggtggtgccttccttgatgagctgaaagctaagtacccatctattttcaaccgtgtgcaaatctcaaatggtaagcagttgcctacgaatgaaaagattacaaaatggtctgctaagtacttcaacggaaccaacatccttggacgaggcatcaattatgtccttcgtgatgacaagaccaaccagtactttaatacttcagccaacggccaactcttgccaacaccacttcgtgacacaggtgccatcacaagcactcaagtcttccaacgtcgtggacaagatgtttacttccttcgtgataatcaagttatcaagaatgaatttgttcaagacggtaacggtaactggtattacttcggtgctgacggtaagatgaccaagggtgcccaaaacatcaatagcaaggattactatttctttgataatggtgttcaattgcgtaacgctcttcgtcgtgcaagcaacggctatacttactattacggtttagatggtgccatgattaagaatgcctttgttgattttgatgacaaacatcagtaa

SEQ ID NO: 126 - protein, 1005 aa, artificial sequence
  T5 C-terminal truncation of GTF0459
INGKQYYVNSDGSVRKNFVFEQDGKSYYFDAETGALATKSQDEFSTEPIKAAVDFSSGNQLYKNDNKSLDQLDTFITADAWYRPKSILKDGKTWTASTEADKRPLLMVWWPDKSTQVNYLNYMQNQGLGAGSFSTNSSQESLNLAAKAVQTKIEERIAREGNTNWLRTSIDQFIKTQPGWNSSTENSSYDHLQGGQLLFNNSKGDTGNRTSYANSDYRLLNRTPTNQSGTRKYFKDNSIGGLEFLLANDIDNSNPAVQAEQLNWLHFMMNIGSIMANDPTANFDGLRVDALDNVDADLLQIASDYFKAVYGVDKSEANAIKHLSYLEAWSANDPYYNKDTKGAQLPIDNALRNALTNLLMRDKNTRMQLGDMTAFMNSSLNPRGANDKNGERMANYIFTRAHDTEAQTIIQRIIRDRINPNLFGYNFTRDEIKKAFEIYNADINTAHKTYASYNLPSVYALMLTNKDSVTRVYYGDLYREDGHYMAKKTPYFDAIDTLLRARIKYVAGGQDMEVKKVGNDGLLTSVRYGKGANNSTDWGTTETRTQGMGVILTNNYDFRLGSNETVTMNMGRAHRNQLYRPLLLTTKDGLATYLNDSDVPSNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGRYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQVIKNEFVQDGNGNWYYFGADGKMTKGAQNINSKDYYFFDNGVQLRNALRRASNGYTYYYGLDGAMIKNAFVDFDDKHQ

SEQ ID NO: 127 - DNA, 3018 bp, artificial sequence
  T4 C-terminal truncation of GTF0974
attaacggcaaacaatactatgtcaatagtgacggtagtgtacgtaaaaacttcgtttttgagcaagatggtaagtcttattactttgatgctgaaacaggggcacttgcgactaagtctcaggatgaattttcaacagaacctatcaaggcaaccgtagatttttcatctggaaaccagctctacaaaaacgatgacaagtctttggaccaactcgacaccttcatcacagcggatgcttggtaccgtccaaagagcattctcaaggatggtaagacttggacagcttcaactgaagcggacaaacgtcctctattgatggtttggtggcctgacaagtctactcaggtcaactaccttaactacatgcaaaatcaaggtcttggagcagggtcattttcaaccaactctagtcaggaaagtctggaccaagctgctaaagcggttcagactaagattgaagaacgtatcgcgcgtgagggcaataccaactggttacgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgacaaaccaaacgggtacacgtaagtacttcaaggacaattctatcggtggtcttgagttcttgcttgccaacgatattgataactcaaacccagctgttcaggcagaacaacttaactggctccactttatgatgaatatcggaagtatcatggcaaatgacccaactgccaactttgacggtttgcgtgtcgacgccttggacaatgtggatgccgaccttctccaaatcgcttcagattactttaaagcagcctatggggttgacaagtctgaagccaatgctattaagcacttgtcatatttggaagcatggtctgccaacgacccatactacaacaaggacactaagggagcacaacttccgattgataatgcccttcgtaacgcccttaccaacctcttgatgcgtgataaaaatacacgtatgcagcttggggacatgactgccttcatcaatagtagtttgaatccacgtggtgccaacgataaaaacggtgaacgtatggctaactatattttcactcgtgcccatgatacagaagctcaaacgattattcaacgtatcatccgtgatcgtattaacccaaatttatttggttacaatttcactcgtgatgaaatcaagaaagccttcgagatttacaatgaggatattgataaggctcacaagacttatgcgtcatacaacttaccatctgtctatgccctcatgttgaccaacaaggactctgtaacacgtgtttattacggagacctctatcgtgaagatggtcactacatggctaaaaagacaccgtactttgatgccatcgacaccctcttgcgtgctcgcatcaagtatgtagctggtggtcaagacatggaagtgaagaaagtcggaaatgatggactcttgacatctgttcgttatggtaaaggtgccaataacagaactgatttgggaacttctgaaacccgtacgcaagggatgggtgtcatcatgaccaacaactatgatttccgcttgggtagcaatgaaaccgtaacgatgaacatgggtagagctcaccgtaatcagctttatcgcccattgcttttgacgacaaaggatggtatagcaacctacctcaacgattctgatgtgcctaaaaaacttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaacaattgataatggttatgcctttgatgaccgttacgatatggccttgagtcaaaataataaatacggatcacttgaggacctccttaacgttcttcgtgctctccacaaagacggtattcaagccattgctgactgggtgccagaccaaatctataacctcccaggaaaagaagtggtaaatgcgacacgtgttaatggttatggtaaccaccaagtaggctaccaaatcattgaccaagcctatgtggctaatactcgtacagatggtacagactatcaaggtaaatacggtggagccttccttgatgagcttaaagctaagtacccatctattttcaaccgtgtgcaaatctcaaatggaaaacagttgcctacgaatgaaaagattactaaatggtctgctaagtacttcaacggaactaatatccttggacgaggtatcaactatgtccttcgtgatgacaagactaaccagtactttaatacttcagccaacagccaactcttgccaacaccacttcgcgatacaggtgccatcacaagcactcaagtcttccaacgtcgtggacaagatgtttatttcctacgtgataaccaagctgttaagaatgaatttgttcaagacggaaacggtaactggtattacttcggtggtgacggtaagatgaccaagggtgcccaaaacatcaataacaaggattactatttctttgacaatggtatccaattgcgtaacgcccttcgtcgtgcttcaaacggctatacctactattacggtctggacggtgccatggttaagaatgccttcgttgattttgatgacaaacataagtaa

SEQ ID NO: 128 - protein, 1005 aa, artificial sequence
  T4 C-terminal truncation of GTF0974
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKKLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSTIDNGYAFDDRYDMALSQNNKYGSLEDLLNVLRALHKDGIQAIADWVPDQIYNLPGKEVVNATRVNGYGNHQVGYQIIDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGGDGKMTKGAQNINNKDYYFFDNGIQLRNALRRASNGYTYYYGLDGAMVKNAFVDFDDKHK

SEQ ID NO: 129 - DNA, 3018 bp, artificial sequence
  T4 C-terminal truncation of GTF4336
attaacggcaaacaatactatgtcaatagtgacggtagtgtgcgtaagaactttgtctttgagcaagatggtaagtcttattactttgatgctgaaacaggggctcttgcgactaagtcacaggatgaattttcaacagaaccaatcaaggcaaccgtcgatttttcatctggaaaccagctctacaaaaacgatgataaatcgttggaccagctcgataccttcatcacagcggatgcttggtaccgtccaaagagcattctcaaggatggtaagacttggacggcttcaactgaggctgacaaacgtccactcttgatggtttggtggcctgacaagtcaactcaggttaactaccttaactacatgcaaaatcaaggtcttggtgcaggctcattttcaaccaactctagccaggaaagtctggaccaagctgctaaagcggttcagactaagattgaagaacgtatcgctcgtgaaggcaacacaaactggttgcgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgactaaccagacgggtacacgtaagtacttcaaggacaattctatcggtggtcttgagttcttgcttgccaacgatattgataactcaaacccagctgttcaggcagagcaacttaactggctccactttatgatgaatattggaagcatcatggcaaatgacccaacagctaactttgacggtttgcgtgtcgatgccttggacaatgtggatgctgaccttctccaaatcgcatcagactacttcaaagcagcctatggtgttgacaagtctgaagccaatgccattaagcacttgtcatacttggaagcatggtctgccaacgacccatactacaataaggacactaagggggcacaacttccgattgacaatgccctccgtaatgcccttaccaacctcttgatgcgtgataagaatacacgtatgcagcttggggacatgactgccttcatcaacagtagtttgaatccacgtggtgccaacgataaaaacggtgaacgtatggcaaactatattttcacccgtgctcacgatacggaagctcaaacgattattcaacgtatcatccgtgatcgtatcaacccaaatttgtttggttacaatttcactcgtgatgaaatcaagaaagccttcgagatttacaatgaggatattgataaggctcacaagacttatgcgtcatacaacttaccatctgtttatgctctcatgttgaccaacaaggactctgtaacacgagtttattacggagacctctaccgtgaagatggtcactacatggctaaaaagacaccgtactttgatgccattgacaccctcttgcgtgctcgtatcaagtatgtagctggtggtcaagacatggaagtgaagaaagtcggaaatgacggcctcttgacatctgttcgttatggtaaaggtgccaataacagaacagatttgggaacttcagaaactcgtacgcaaggtatgggtgtcatcatgaccaacaactatgatttccgcttgggtagcaatgaaactgtaacgatgaacatgggtagagcacaccgtaatcagctttatcgcccattgcttttgacgacaaaggatggtatagcaacctacttcaacgattctgatgtgcctaaaaaccttctgaaacgtactgactggaatgggaacttgaccttcaatgccaatgatgtttttggtgtggaaaatgtccaagtatcaggttaccttggtgtctgggtaccagtcggggctaaggctaaccaagacgcacgtacacagccaagtaaccgtgccaatagcgatggtcaagtttacaagtcttcagcagcccttgattcgcaagtcatgtatgaagccttctcaaacttccaagcatttgcggacgatcagccagaactctacatgaaccgtgtcttggctaagaacactgacttgctcaaagcatggggtgttacgtctgttggacttccaccacagtacgtttcaagtaaggatggtaccttccttgattcaacaattgacaatggttatgcctttgatgaccgttatgacatggccttgagtcaaaataacaagtatggctcacttgaggacctccttaatgttcttcgtgccctccacaaagatggtattcaagccattgctgactgggtgccagaccaaatttataaccttccaggaaaagaagtagttaatgccacacgtgttaacggctacggttatcaccaacaaggttatcaaattgtggaccaagcctatgtggcaaatacccgtacagatggtacagactatcaaggtaaatacggtggagccttccttgatgagcttaaagctaagtacccatctattttcaaccgtgtgcaaatctcaaatggtaagcagttacctacgaatgaaaagattactaaatggtctgctaagtacttcaacggaactaatatccttggacgaggtatcaactatgtccttcgtgatgacaagaccaaccagtactttaatacctcagctaacagccaactcttgccaacaccacttcgtgacacaggtgccattacaagcactcaagtcttccaacgtcgtggacaagatgtttacttccttcgtgataaccaagccgttaagaatgaatttgttcaagacggtaacggcaactggtattacttcggtgctgacggtaagatgaccaagggtgctcaaaccatcaataaaaaggattactatttctttgacaatggtatccaattgcgtaacgcccttcgtcgtgctaacaacggttatacttactattacggtttagacggtgctatggttaagaatgcctttgttgattttgacgacaagcgtaagtaa

SEQ ID NO: 130 - protein, 1005 aa, artificial sequence
  T4 C-terminal truncation of GTF4336
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYFNDSDVPKNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGADGKMTKGAQTINKKDYYFFDNGIQLRNALRRANNGYTYYYGLDGAMVKNAFVDFDDKRK

SEQ ID NO: 131 - DNA, 3018 bp, artificial sequence
  T4 C-terminal truncation of GTF4491
atcaacggcaaacaatactatgtcaatagtgacggtagtgtgcgtaagaactttgtttttgagcaagatggtaagtcttattactttgatgctgaaacaggggctcttgcgactaagtcacaggatgaattttcaacagaacctatcaaggcaaccgtagatttttcatctggtaaccagctctacaaaaacgatgacaaatctttggaccaacttgacaccttcatcacagcggatgcttggtaccgtccaaagagcattctcaaggatggtaagacttggacagcttcaactgaagctgacaaacgtcctctcttgatggtttggtggcctgacaagtctactcaggtcaactaccttaactacatgcaaaatcaaggtcttggtgcagggtcattttcaaccaactctagccaggaaagtctggaccaagctgctaaagcggttcagactaagattgaagaacgtatcgcgcgtgagggcaataccaactggttgcgtacaagtatcgaccagttcatcaagacacagccaggttggaatagtagcactgaaaatagttcatacgaccacttgcaaggcggacagttgctctttaacaacagtaagggtgatactggcaaccgtaccagccacgccaactctgactatcgtttgttaaaccgcacaccgactaaccagacgggtacacgtaagtacttcaaggataattctatcggtggtcttgagttcttgcttgccaacgatattgataactcaaacccagctgttcaggcagagcaacttaactggctccactttatgatgaatatcggaagcatcatggctaatgacccaactgccaactttgacggtttgcgtgtcgatgccttggacaatgtggatgccgacctgctccaaatcgcatcagactacttcaaagcagcctatggtgttgacaagtctgaagccaatgccatcaagcacttgtcatacttggaagcatggtctgccaacgacccatactacaacaaggacactaagggagcacaacttccgattgacaatgcccttcgtaatgccctcaccaacctcttgatgcgtgataaaaatacacgtatgcagcttggagacatgactgctttcatcaacagtagtttgaacccacgaggtgccaacgataaaaacggtgaacgtatggcaaactatattttcacccgtgcccatgatacagaagctcaaaccattattcaacgtatcattcgtgatcgtattaacccaaatttgtttggttataatttcacacgtgatgaaatcaagaaagccttcgagatttacaatgaggatattgataaggctcacaagacttatgcgtcatacaacttgccatctgtctatgccctcatgttgaccaataaggactctgtaacacgtgtttattacggagacctctaccgtgaagatggtcactacatggctaagaagacgccttactttgatgccatcgacaccctcttgcgtgcccgtatcaagtatgtagctggtggtcaagacatggaagtgaagaaagtcggaaatgacggcctcttgacatcagttcgttatggtaaaggtgccaataacagaactgatttgggaacttctgaaactcgtacgcaaggtatgggtgtcatcatgaccaacaactatgatttccgcttgggtagcaatgaaactgtaacgatgaacatgggtagagctcaccgtaatcagctttatcgaccattgcttttgacgacaaaggatggtatagcaacctacctcaacgattctgatgtgcctaaaaaccttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaataattgataatggttatgcctttgatgaccgttacgatatggccttgagtcaaaataataaatacggatcacttgaggacctccttaacgttcttcgtgccctccataaagacggtattcaagccattgctgactgggtaccagaccaaatctataacctcccaggaaaagaagtggtaaatgcgacacgtgttaacggctacggttatcaccaacaaggttatcaaattgtggaccaagcctatgtggcaaatacccgtacagatggtacagactatcaaggcaagtacggtggtgccttccttgatgagctgaaagctaagtacccatctattttcaaccgtgtgcaaatctcaaatggtaagcaattgcctacgaatgaaaagattacaaaatggtctgctaagtacttcaacggaaccaacatccttggacgaggcatcaactttgtccttcgtgatgacaagaccaaccagtactttaatacttcagctaacagccaactcttgccaacaccacttcgtgatacgggtgccatcacaagcactcaagtcttccaacgtcgtggacaagatgtttacttccttcgcgataaccaaaccgttaagaatgaatttgttcaagacggtaacggtaactggtattacttcggtggtgacggtaagatgaccaagggtgcccaaaacatcaatagcaaggattactatttctttgataatggtgttcaattgcgtaatgccctgcgtcgtgcttcaaacggctatacttactattacggtctggacggtgctatggttaagaatgccttcgttgattttgatgacaagcataagtaa

SEQ ID NO: 132 - protein, 1005 aa, artificial sequence
  T4 C-terminal truncation of GTF4491
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKNLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSIIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINFVLRDDKTNQYFNTSANSQLLPTPLRDTGAITSTQVFQRRGQDVYFLRDNQTVKNEFVQDGNGNWYYFGGDGKMTKGAQNINSKDYYFFDNGVQLRNALRRASNGYTYYYGLDGAMVKNAFVDFDDKHK

SEQ ID NO: 133 - DNA, 3042 bp, artificial sequence
  T6 C-terminal truncation of GTF0459
atcaacggcaaacaatactatgtcaatagtgacggtagtgtgcgtaagaacttcgtttttgagcaagatggtaagtcatattactttgatgctgaaacaggggctcttgcgaccaagtcacaggatgaattttcaacagaacctatcaaggcagctgtggatttttcatctggaaatcagctctacaaaaacgataacaaatctttggaccaactcgacaccttcatcactgcggatgcttggtaccgtccaaagagtattctcaaggatggtaagacttggacagcttcaactgaagcggacaaacgtcctctcttgatggtttggtggcctgacaaatcgactcaggttaactaccttaactacatgcaaaatcaaggtcttggtgcgggatcattttcaaccaactctagccaggaaagtctaaatctagctgctaaagcggttcagactaagattgaagaacgtattgcgcgtgaaggcaataccaactggttgcgtacaagtatcgaccagttcatcaagactcagccaggttggaatagtagcactgaaaatagttcttatgaccacttacaaggcggacagttgctctttaacaacagtaagggtgatactggtaaccgtactagctacgccaactctgattatcgtttgcttaaccgcacaccgacaaaccagagtgggacacgtaagtatttcaaggataattctatcggtggtcttgagttcttgcttgccaacgatattgacaactcaaacccagctgttcaggcggagcaacttaactggctccactttatgatgaatattggaagcatcatggccaatgacccaacagccaactttgacggtttgcgtgtcgatgctttggacaatgtggatgccgaccttctccaaatcgcttcagattacttcaaagcagtctatggtgttgacaagtccgaagctaatgcgatcaaacacttgtcatacttggaagcgtggtctgccaacgacccatactacaacaaggatactaagggggcacaactgccgattgataatgcccttcgtaatgctcttaccaaccttttgatgcgtgataaaaatacacgtatgcagcttggggacatgactgcttttatgaatagtagtttgaatccacgtggtgctaacgataagaacggtgaacgtatggctaactatattttcacccgtgcccacgatactgaagcgcaaaccattatccaacgtatcatccgtgatcgtatcaacccaaatctgtttggttacaatttcacccgtgatgaaatcaagaaggctttcgagatttacaatgcggatatcaatacagctcacaagacttatgcgtcatacaacttgccatctgtctatgccctcatgttgaccaacaaggactctgtgacacgtgtttattatggagacctctaccgtgaagacggtcactacatggccaagaagacgccttactttgatgccatcgatacccttttgcgtgcccgtatcaagtatgtggccggtggtcaagacatggaagtgaagaaagtcggaaatgatggacttttgacttctgttcgttatggtaagggtgccaataacagcactgattggggaactactgaaacccgtacgcaagggatgggtgtcattttgaccaataactacgatttccgcttgggtagcaatgaaactgtaacgatgaatatgggtagagcccaccgtaatcagctttaccgtccattgcttttgacgactaaggatggtctagcaacctacctcaacgattctgatgtaccttcaaaccttcttaaacgtaccgactggaatgggaatttgaccttcaatgccaacgatgtttttggtgtggaaaatgtgcaagtatcaggttacctcggtgtctgggtaccagtcggggctaaggctaaccaagacgcacgtacacagccaagtaaccgtgccaatagtgatggtcaagtttacaagtcttcagcagcccttgattcgcaagttatgtatgaagccttctcaaacttccaagcgtttgcggacgatcagccagaactctacatgaaccgtgtcttggctaagaacactgacttgctcaaagcgtggggtgttacatctgttggacttccaccacagtacgtttcaagtaaggatggtaccttcctcgattcaacgattgacaatggttatgcctttgatgaccgttatgacatggccttgagtcaaaataataaatatggctcacttgaggacctccttaacgtccttcgtgccctccacaaagatggtattcaagccattgctgactgggtgccagaccaaatctataaccttccaggtaaggaagtggtgaatgccacacgtgttaacggctacggttatcaccaacaaggttatcaaattgtggaccaagcctatgtggcaaatacccgtacagatggtacagactatcaaggtagatacggtggtgccttccttgatgagctgaaagctaagtacccatctattttcaaccgtgtgcaaatctcaaatggtaagcagttgcctacgaatgaaaagattacaaaatggtctgctaagtacttcaacggaaccaacatccttggacgaggcatcaattatgtccttcgtgatgacaagaccaaccagtactttaatacttcagccaacggccaactcttgccaacaccacttcgtgacacaggtgccatcacaagcactcaagtcttccaacgtcgtggacaagatgtttacttccttcgtgataatcaagttatcaagaatgaatttgttcaagacggtaacggtaactggtattacttcggtgctgacggtaagatgaccaagggtgcccaaaacatcaatagcaaggattactatttctttgataatggtgttcaattgcgtaacgctcttcgtcgtgcaagcaacggctatacttactattacggtttagatggtgccatgattaagaatgcctttgttgattttgatgacaaacatcagcaagttcgtgcctttacgactcaataa

SEQ ID NO: 134 - protein, 1013 aa, artificial sequence
  T6 C-terminal truncation of GTF0459
INGKQYYVNSDGSVRKNFVFEQDGKSYYFDAETGALATKSQDEFSTEPIKAAVDFSSGNQLYKNDNKSLDQLDTFITADAWYRPKSILKDGKTWTASTEADKRPLLMVWWPDKSTQVNYLNYMQNQGLGAGSFSTNSSQESLNLAAKAVQTKIEERIAREGNTNWLRTSIDQFIKTQPGWNSSTENSSYDHLQGGQLLFNNSKGDTGNRTSYANSDYRLLNRTPTNQSGTRKYFKDNSIGGLEFLLANDIDNSNPAVQAEQLNWLHFMMNIGSIMANDPTANFDGLRVDALDNVDADLLQIASDYFKAVYGVDKSEANAIKHLSYLEAWSANDPYYNKDTKGAQLPIDNALRNALTNLLMRDKNTRMQLGDMTAFMNSSLNPRGANDKNGERMANYIFTRAHDTEAQTIIQRIIRDRINPNLFGYNFTRDEIKKAFEIYNADINTAHKTYASYNLPSVYALMLTNKDSVTRVYYGDLYREDGHYMAKKTPYFDAIDTLLRARIKYVAGGQDMEVKKVGNDGLLTSVRYGKGANNSTDWGTTETRTQGMGVILTNNYDFRLGSNETVTMNMGRAHRNQLYRPLLLTTKDGLATYLNDSDVPSNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGRYGGAFLDELKAKYPSIFNRVQISNGKQLPTNEKITKWSAKYFNGTNILGRGINYVLRDDKTNQYFNTSANGQLLPTPLRDTGAITSTQVFQRRGQDVYFLRDNQVIKNEFVQDGNGNWYYFGADGKMTKGAQNINSKDYYFFDNGVQLRNALRRASNGYTYYYGLDGAMIKNAFVDFDDKHQQVRAFTTQ

SEQ ID NO: 135 - DNA, 2727 bp, artificial sequence
  T1 C-terminal truncation of GTF0974
attaacggcaaacaatactatgtcaatagtgacggtagtgtacgtaaaaacttcgtttttgagcaagatggtaagtcttattactttgatgctgaaacaggggcacttgcgactaagtctcaggatgaattttcaacagaacctatcaaggcaaccgtagatttttcatctggaaaccagctctacaaaaacgatgacaagtctttggaccaactcgacaccttcatcacagcggatgcttggtaccgtccaaagagcattctcaaggatggtaagacttggacagcttcaactgaagcggacaaacgtcctctattgatggtttggtggcctgacaagtctactcaggtcaactaccttaactacatgcaaaatcaaggtcttggagcagggtcattttcaaccaactctagtcaggaaagtctggaccaagctgctaaagcggttcagactaagattgaagaacgtatcgcgcgtgagggcaataccaactggttacgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgacaaaccaaacgggtacacgtaagtacttcaaggacaattctatcggtggtcttgagttcttgcttgccaacgatattgataactcaaacccagctgttcaggcagaacaacttaactggctccactttatgatgaatatcggaagtatcatggcaaatgacccaactgccaactttgacggtttgcgtgtcgacgccttggacaatgtggatgccgaccttctccaaatcgcttcagattactttaaagcagcctatggggttgacaagtctgaagccaatgctattaagcacttgtcatatttggaagcatggtctgccaacgacccatactacaacaaggacactaagggagcacaacttccgattgataatgcccttcgtaacgcccttaccaacctcttgatgcgtgataaaaatacacgtatgcagcttggggacatgactgccttcatcaatagtagtttgaatccacgtggtgccaacgataaaaacggtgaacgtatggctaactatattttcactcgtgcccatgatacagaagctcaaacgattattcaacgtatcatccgtgatcgtattaacccaaatttatttggttacaatttcactcgtgatgaaatcaagaaagccttcgagatttacaatgaggatattgataaggctcacaagacttatgcgtcatacaacttaccatctgtctatgccctcatgttgaccaacaaggactctgtaacacgtgtttattacggagacctctatcgtgaagatggtcactacatggctaaaaagacaccgtactttgatgccatcgacaccctcttgcgtgctcgcatcaagtatgtagctggtggtcaagacatggaagtgaagaaagtcggaaatgatggactcttgacatctgttcgttatggtaaaggtgccaataacagaactgatttgggaacttctgaaacccgtacgcaagggatgggtgtcatcatgaccaacaactatgatttccgcttgggtagcaatgaaaccgtaacgatgaacatgggtagagctcaccgtaatcagctttatcgcccattgcttttgacgacaaaggatggtatagcaacctacctcaacgattctgatgtgcctaaaaaacttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaacaattgataatggttatgcctttgatgaccgttacgatatggccttgagtcaaaataataaatacggatcacttgaggacctccttaacgttcttcgtgctctccacaaagacggtattcaagccattgctgactgggtgccagaccaaatctataacctcccaggaaaagaagtggtaaatgcgacacgtgttaatggttatggtaaccaccaagtaggctaccaaatcattgaccaagcctatgtggctaatactcgtacagatggtacagactatcaaggtaaatacggtggagccttccttgatgagcttaaagctaagtacccatctattttcaaccgtgtgcaaatctcaaatggaaaacagttgcctacgaatgaaaagattactaaatggtctgctaagtacttcaacggaactaatatccttggacgaggtatcaactatgtccttcgtgatgacaagactaaccagtactttaatacttcagccaacagccaactcttgccaacaccacttcgcgatacaggtgccatcacataa

SEQ ID NO: 136 - protein, 908 aa, artificial sequence
  T1 C-terminal truncation of GTF0974
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKKLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSTIDNGYAFDDRYDMALSQNNKYGSLEDLLNVLRALHKDGIQAIADWVPDQIYNLPGKEVVNATRVNGYGNHQVGYQIIDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAIT

SEQ ID NO: 137 - DNA, 2847 bp, artificial sequence
  T2 C-terminal truncation of GTF0974
attaacggcaaacaatactatgtcaatagtgacggtagtgtacgtaaaaacttcgtttttgagcaagatggtaagtcttattactttgatgctgaaacaggggcacttgcgactaagtctcaggatgaattttcaacagaacctatcaaggcaaccgtagatttttcatctggaaaccagctctacaaaaacgatgacaagtctttggaccaactcgacaccttcatcacagcggatgcttggtaccgtccaaagagcattctcaaggatggtaagacttggacagcttcaactgaagcggacaaacgtcctctattgatggtttggtggcctgacaagtctactcaggtcaactaccttaactacatgcaaaatcaaggtcttggagcagggtcattttcaaccaactctagtcaggaaagtctggaccaagctgctaaagcggttcagactaagattgaagaacgtatcgcgcgtgagggcaataccaactggttacgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgacaaaccaaacgggtacacgtaagtacttcaaggacaattctatcggtggtcttgagttcttgcttgccaacgatattgataactcaaacccagctgttcaggcagaacaacttaactggctccactttatgatgaatatcggaagtatcatggcaaatgacccaactgccaactttgacggtttgcgtgtcgacgccttggacaatgtggatgccgaccttctccaaatcgcttcagattactttaaagcagcctatggggttgacaagtctgaagccaatgctattaagcacttgtcatatttggaagcatggtctgccaacgacccatactacaacaaggacactaagggagcacaacttccgattgataatgcccttcgtaacgcccttaccaacctcttgatgcgtgataaaaatacacgtatgcagcttggggacatgactgccttcatcaatagtagtttgaatccacgtggtgccaacgataaaaacggtgaacgtatggctaactatattttcactcgtgcccatgatacagaagctcaaacgattattcaacgtatcatccgtgatcgtattaacccaaatttatttggttacaatttcactcgtgatgaaatcaagaaagccttcgagatttacaatgaggatattgataaggctcacaagacttatgcgtcatacaacttaccatctgtctatgccctcatgttgaccaacaaggactctgtaacacgtgtttattacggagacctctatcgtgaagatggtcactacatggctaaaaagacaccgtactttgatgccatcgacaccctcttgcgtgctcgcatcaagtatgtagctggtggtcaagacatggaagtgaagaaagtcggaaatgatggactcttgacatctgttcgttatggtaaaggtgccaataacagaactgatttgggaacttctgaaacccgtacgcaagggatgggtgtcatcatgaccaacaactatgatttccgcttgggtagcaatgaaaccgtaacgatgaacatgggtagagctcaccgtaatcagctttatcgcccattgcttttgacgacaaaggatggtatagcaacctacctcaacgattctgatgtgcctaaaaaacttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaacaattgataatggttatgcctttgatgaccgttacgatatggccttgagtcaaaataataaatacggatcacttgaggacctccttaacgttcttcgtgctctccacaaagacggtattcaagccattgctgactgggtgccagaccaaatctataacctcccaggaaaagaagtggtaaatgcgacacgtgttaatggttatggtaaccaccaagtaggctaccaaatcattgaccaagcctatgtggctaatactcgtacagatggtacagactatcaaggtaaatacggtggagccttccttgatgagcttaaagctaagtacccatctattttcaaccgtgtgcaaatctcaaatggaaaacagttgcctacgaatgaaaagattactaaatggtctgctaagtacttcaacggaactaatatccttggacgaggtatcaactatgtccttcgtgatgacaagactaaccagtactttaatacttcagccaacagccaactcttgccaacaccacttcgcgatacaggtgccatcacaagcactcaagtcttccaacgtcgtggacaagatgtttatttcctacgtgataaccaagctgttaagaatgaatttgttcaagacggaaacggtaactggtattacttcggtggtgacggttaa

SEQ ID NO: 138 - protein, 948 aa, artificial sequence
  T2 C-terminal truncation of GTF0974
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKKLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSTIDNGYAFDDRYDMALSQNNKYGSLEDLLNVLRALHKDGIQAIADWVPDQIYNLPGKEVVNATRVNGYGNHQVGYQIIDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGGDG

SEQ ID NO: 139 - DNA, 3045 bp, artificial sequence
  T6 C-terminal truncation of GTF0974
attaacggcaaacaatactatgtcaatagtgacggtagtgtacgtaaaaacttcgtttttgagcaagatggtaagtcttattactttgatgctgaaacaggggcacttgcgactaagtctcaggatgaattttcaacagaacctatcaaggcaaccgtagatttttcatctggaaaccagctctacaaaaacgatgacaagtctttggaccaactcgacaccttcatcacagcggatgcttggtaccgtccaaagagcattctcaaggatggtaagacttggacagcttcaactgaagcggacaaacgtcctctattgatggtttggtggcctgacaagtctactcaggtcaactaccttaactacatgcaaaatcaaggtcttggagcagggtcattttcaaccaactctagtcaggaaagtctggaccaagctgctaaagcggttcagactaagattgaagaacgtatcgcgcgtgagggcaataccaactggttacgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgacaaaccaaacgggtacacgtaagtacttcaaggacaattctatcggtggtcttgagttcttgcttgccaacgatattgataactcaaacccagctgttcaggcagaacaacttaactggctccactttatgatgaatatcggaagtatcatggcaaatgacccaactgccaactttgacggtttgcgtgtcgacgccttggacaatgtggatgccgaccttctccaaatcgcttcagattactttaaagcagcctatggggttgacaagtctgaagccaatgctattaagcacttgtcatatttggaagcatggtctgccaacgacccatactacaacaaggacactaagggagcacaacttccgattgataatgcccttcgtaacgcccttaccaacctcttgatgcgtgataaaaatacacgtatgcagcttggggacatgactgccttcatcaatagtagtttgaatccacgtggtgccaacgataaaaacggtgaacgtatggctaactatattttcactcgtgcccatgatacagaagctcaaacgattattcaacgtatcatccgtgatcgtattaacccaaatttatttggttacaatttcactcgtgatgaaatcaagaaagccttcgagatttacaatgaggatattgataaggctcacaagacttatgcgtcatacaacttaccatctgtctatgccctcatgttgaccaacaaggactctgtaacacgtgtttattacggagacctctatcgtgaagatggtcactacatggctaaaaagacaccgtactttgatgccatcgacaccctcttgcgtgctcgcatcaagtatgtagctggtggtcaagacatggaagtgaagaaagtcggaaatgatggactcttgacatctgttcgttatggtaaaggtgccaataacagaactgatttgggaacttctgaaacccgtacgcaagggatgggtgtcatcatgaccaacaactatgatttccgcttgggtagcaatgaaaccgtaacgatgaacatgggtagagctcaccgtaatcagctttatcgcccattgcttttgacgacaaaggatggtatagcaacctacctcaacgattctgatgtgcctaaaaaacttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaacaattgataatggttatgcctttgatgaccgttacgatatggccttgagtcaaaataataaatacggatcacttgaggacctccttaacgttcttcgtgctctccacaaagacggtattcaagccattgctgactgggtgccagaccaaatctataacctcccaggaaaagaagtggtaaatgcgacacgtgttaatggttatggtaaccaccaagtaggctaccaaatcattgaccaagcctatgtggctaatactcgtacagatggtacagactatcaaggtaaatacggtggagccttccttgatgagcttaaagctaagtacccatctattttcaaccgtgtgcaaatctcaaatggaaaacagttgcctacgaatgaaaagattactaaatggtctgctaagtacttcaacggaactaatatccttggacgaggtatcaactatgtccttcgtgatgacaagactaaccagtactttaatacttcagccaacagccaactcttgccaacaccacttcgcgatacaggtgccatcacaagcactcaagtcttccaacgtcgtggacaagatgtttatttcctacgtgataaccaagctgttaagaatgaatttgttcaagacggaaacggtaactggtattacttcggtggtgacggtaagatgaccaagggtgcccaaaacatcaataacaaggattactatttctttgacaatggtatccaattgcgtaacgcccttcgtcgtgcttcaaacggctatacctactattacggtctggacggtgccatggttaagaatgccttcgttgattttgatgacaaacataagcaggttcgtgcctttacgactcaaggataa

SEQ ID NO: 140 - protein, 1014 aa, artificial sequence
  T6 C-terminal truncation of GTF0974
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKKLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSTIDNGYAFDDRYDMALSQNNKYGSLEDLLNVLRALHKDGIQAIADWVPDQIYNLPGKEVVNATRVNGYGNHQVGYQIIDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGGDGKMTKGAQNINNKDYYFFDNGIQLRNALRRASNGYTYYYGLDGAMVKNAFVDFDDKHKQVRAFTTQG

SEQ ID NO: 141 - DNA, 2727 bp, artificial sequence
  T1 C-terminal truncation of GTF4336
attaacggcaaacaatactatgtcaatagtgacggtagtgtgcgtaagaactttgtctttgagcaagatggtaagtcttattactttgatgctgaaacaggggctcttgcgactaagtcacaggatgaattttcaacagaaccaatcaaggcaaccgtcgatttttcatctggaaaccagctctacaaaaacgatgataaatcgttggaccagctcgataccttcatcacagcggatgcttggtaccgtccaaagagcattctcaaggatggtaagacttggacggcttcaactgaggctgacaaacgtccactcttgatggtttggtggcctgacaagtcaactcaggttaactaccttaactacatgcaaaatcaaggtcttggtgcaggctcattttcaaccaactctagccaggaaagtctggaccaagctgctaaagcggttcagactaagattgaagaacgtatcgctcgtgaaggcaacacaaactggttgcgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgactaaccagacgggtacacgtaagtacttcaaggacaattctatcggtggtcttgagttcttgcttgccaacgatattgataactcaaacccagctgttcaggcagagcaacttaactggctccactttatgatgaatattggaagcatcatggcaaatgacccaacagctaactttgacggtttgcgtgtcgatgccttggacaatgtggatgctgaccttctccaaatcgcatcagactacttcaaagcagcctatggtgttgacaagtctgaagccaatgccattaagcacttgtcatacttggaagcatggtctgccaacgacccatactacaataaggacactaagggggcacaacttccgattgacaatgccctccgtaatgcccttaccaacctcttgatgcgtgataagaatacacgtatgcagcttggggacatgactgccttcatcaacagtagtttgaatccacgtggtgccaacgataaaaacggtgaacgtatggcaaactatattttcacccgtgctcacgatacggaagctcaaacgattattcaacgtatcatccgtgatcgtatcaacccaaatttgtttggttacaatttcactcgtgatgaaatcaagaaagccttcgagatttacaatgaggatattgataaggctcacaagacttatgcgtcatacaacttaccatctgtttatgctctcatgttgaccaacaaggactctgtaacacgagtttattacggagacctctaccgtgaagatggtcactacatggctaaaaagacaccgtactttgatgccattgacaccctcttgcgtgctcgtatcaagtatgtagctggtggtcaagacatggaagtgaagaaagtcggaaatgacggcctcttgacatctgttcgttatggtaaaggtgccaataacagaacagatttgggaacttcagaaactcgtacgcaaggtatgggtgtcatcatgaccaacaactatgatttccgcttgggtagcaatgaaactgtaacgatgaacatgggtagagcacaccgtaatcagctttatcgcccattgcttttgacgacaaaggatggtatagcaacctacttcaacgattctgatgtgcctaaaaaccttctgaaacgtactgactggaatgggaacttgaccttcaatgccaatgatgtttttggtgtggaaaatgtccaagtatcaggttaccttggtgtctgggtaccagtcggggctaaggctaaccaagacgcacgtacacagccaagtaaccgtgccaatagcgatggtcaagtttacaagtcttcagcagcccttgattcgcaagtcatgtatgaagccttctcaaacttccaagcatttgcggacgatcagccagaactctacatgaaccgtgtcttggctaagaacactgacttgctcaaagcatggggtgttacgtctgttggacttccaccacagtacgtttcaagtaaggatggtaccttccttgattcaacaattgacaatggttatgcctttgatgaccgttatgacatggccttgagtcaaaataacaagtatggctcacttgaggacctccttaatgttcttcgtgccctccacaaagatggtattcaagccattgctgactgggtgccagaccaaatttataaccttccaggaaaagaagtagttaatgccacacgtgttaacggctacggttatcaccaacaaggttatcaaattgtggaccaagcctatgtggcaaatacccgtacagatggtacagactatcaaggtaaatacggtggagccttccttgatgagcttaaagctaagtacccatctattttcaaccgtgtgcaaatctcaaatggtaagcagttacctacgaatgaaaagattactaaatggtctgctaagtacttcaacggaactaatatccttggacgaggtatcaactatgtccttcgtgatgacaagaccaaccagtactttaatacctcagctaacagccaactcttgccaacaccacttcgtgacacaggtgccattacataa

SEQ ID NO: 142 - protein, 908 aa, artificial sequence
  T1 C-terminal truncation of GTF4336
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYFNDSDVPKNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAIT

SEQ ID NO: 143 - DNA, 2847 bp, artificial sequence
  T2 C-terminal truncation of GTF4336
attaacggcaaacaatactatgtcaatagtgacggtagtgtgcgtaagaactttgtctttgagcaagatggtaagtcttattactttgatgctgaaacaggggctcttgcgactaagtcacaggatgaattttcaacagaaccaatcaaggcaaccgtcgatttttcatctggaaaccagctctacaaaaacgatgataaatcgttggaccagctcgataccttcatcacagcggatgcttggtaccgtccaaagagcattctcaaggatggtaagacttggacggcttcaactgaggctgacaaacgtccactcttgatggtttggtggcctgacaagtcaactcaggttaactaccttaactacatgcaaaatcaaggtcttggtgcaggctcattttcaaccaactctagccaggaaagtctggaccaagctgctaaagcggttcagactaagattgaagaacgtatcgctcgtgaaggcaacacaaactggttgcgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgactaaccagacgggtacacgtaagtacttcaaggacaattctatcggtggtcttgagttcttgcttgccaacgatattgataactcaaacccagctgttcaggcagagcaacttaactggctccactttatgatgaatattggaagcatcatggcaaatgacccaacagctaactttgacggtttgcgtgtcgatgccttggacaatgtggatgctgaccttctccaaatcgcatcagactacttcaaagcagcctatggtgttgacaagtctgaagccaatgccattaagcacttgtcatacttggaagcatggtctgccaacgacccatactacaataaggacactaagggggcacaacttccgattgacaatgccctccgtaatgcccttaccaacctcttgatgcgtgataagaatacacgtatgcagcttggggacatgactgccttcatcaacagtagtttgaatccacgtggtgccaacgataaaaacggtgaacgtatggcaaactatattttcacccgtgctcacgatacggaagctcaaacgattattcaacgtatcatccgtgatcgtatcaacccaaatttgtttggttacaatttcactcgtgatgaaatcaagaaagccttcgagatttacaatgaggatattgataaggctcacaagacttatgcgtcatacaacttaccatctgtttatgctctcatgttgaccaacaaggactctgtaacacgagtttattacggagacctctaccgtgaagatggtcactacatggctaaaaagacaccgtactttgatgccattgacaccctcttgcgtgctcgtatcaagtatgtagctggtggtcaagacatggaagtgaagaaagtcggaaatgacggcctcttgacatctgttcgttatggtaaaggtgccaataacagaacagatttgggaacttcagaaactcgtacgcaaggtatgggtgtcatcatgaccaacaactatgatttccgcttgggtagcaatgaaactgtaacgatgaacatgggtagagcacaccgtaatcagctttatcgcccattgcttttgacgacaaaggatggtatagcaacctacttcaacgattctgatgtgcctaaaaaccttctgaaacgtactgactggaatgggaacttgaccttcaatgccaatgatgtttttggtgtggaaaatgtccaagtatcaggttaccttggtgtctgggtaccagtcggggctaaggctaaccaagacgcacgtacacagccaagtaaccgtgccaatagcgatggtcaagtttacaagtcttcagcagcccttgattcgcaagtcatgtatgaagccttctcaaacttccaagcatttgcggacgatcagccagaactctacatgaaccgtgtcttggctaagaacactgacttgctcaaagcatggggtgttacgtctgttggacttccaccacagtacgtttcaagtaaggatggtaccttccttgattcaacaattgacaatggttatgcctttgatgaccgttatgacatggccttgagtcaaaataacaagtatggctcacttgaggacctccttaatgttcttcgtgccctccacaaagatggtattcaagccattgctgactgggtgccagaccaaatttataaccttccaggaaaagaagtagttaatgccacacgtgttaacggctacggttatcaccaacaaggttatcaaattgtggaccaagcctatgtggcaaatacccgtacagatggtacagactatcaaggtaaatacggtggagccttccttgatgagcttaaagctaagtacccatctattttcaaccgtgtgcaaatctcaaatggtaagcagttacctacgaatgaaaagattactaaatggtctgctaagtacttcaacggaactaatatccttggacgaggtatcaactatgtccttcgtgatgacaagaccaaccagtactttaatacctcagctaacagccaactcttgccaacaccacttcgtgacacaggtgccattacaagcactcaagtcttccaacgtcgtggacaagatgtttacttccttcgtgataaccaagccgttaagaatgaatttgttcaagacggtaacggcaactggtattacttcggtgctgacggttaa

SEQ ID NO: 144 - protein, 948 aa, artificial sequence
  T2 C-terminal truncation of GTF4336
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYFNDSDVPKNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGADG

SEQ ID NO: 145 - DNA, 3045 bp, artificial sequence
  T6 C-terminal truncation of GTF4336
attaacggcaaacaatactatgtcaatagtgacggtagtgtgcgtaagaactttgtctttgagcaagatggtaagtcttattactttgatgctgaaacaggggctcttgcgactaagtcacaggatgaattttcaacagaaccaatcaaggcaaccgtcgatttttcatctggaaaccagctctacaaaaacgatgataaatcgttggaccagctcgataccttcatcacagcggatgcttggtaccgtccaaagagcattctcaaggatggtaagacttggacggcttcaactgaggctgacaaacgtccactcttgatggtttggtggcctgacaagtcaactcaggttaactaccttaactacatgcaaaatcaaggtcttggtgcaggctcattttcaaccaactctagccaggaaagtctggaccaagctgctaaagcggttcagactaagattgaagaacgtatcgctcgtgaaggcaacacaaactggttgcgtacaagtatcgaccagttcatcaagactcagccaggttggaatagtagcactgaaaatagttcatacgaccacttgcaaggcggacagttgctctttaacaacagtaagggtgatactggcaaccgtaccagccacgccaactctgactatcgtttgcttaaccgcacaccgactaaccagacgggtacacgtaagtacttcaaggacaattctatcggtggtcttgagttcttgcttgccaacgatattgataactcaaacccagctgttcaggcagagcaacttaactggctccactttatgatgaatattggaagcatcatggcaaatgacccaacagctaactttgacggtttgcgtgtcgatgccttggacaatgtggatgctgaccttctccaaatcgcatcagactacttcaaagcagcctatggtgttgacaagtctgaagccaatgccattaagcacttgtcatacttggaagcatggtctgccaacgacccatactacaataaggacactaagggggcacaacttccgattgacaatgccctccgtaatgcccttaccaacctcttgatgcgtgataagaatacacgtatgcagcttggggacatgactgccttcatcaacagtagtttgaatccacgtggtgccaacgataaaaacggtgaacgtatggcaaactatattttcacccgtgctcacgatacggaagctcaaacgattattcaacgtatcatccgtgatcgtatcaacccaaatttgtttggttacaatttcactcgtgatgaaatcaagaaagccttcgagatttacaatgaggatattgataaggctcacaagacttatgcgtcatacaacttaccatctgtttatgctctcatgttgaccaacaaggactctgtaacacgagtttattacggagacctctaccgtgaagatggtcactacatggctaaaaagacaccgtactttgatgccattgacaccctcttgcgtgctcgtatcaagtatgtagctggtggtcaagacatggaagtgaagaaagtcggaaatgacggcctcttgacatctgttcgttatggtaaaggtgccaataacagaacagatttgggaacttcagaaactcgtacgcaaggtatgggtgtcatcatgaccaacaactatgatttccgcttgggtagcaatgaaactgtaacgatgaacatgggtagagcacaccgtaatcagctttatcgcccattgcttttgacgacaaaggatggtatagcaacctacttcaacgattctgatgtgcctaaaaaccttctgaaacgtactgactggaatgggaacttgaccttcaatgccaatgatgtttttggtgtggaaaatgtccaagtatcaggttaccttggtgtctgggtaccagtcggggctaaggctaaccaagacgcacgtacacagccaagtaaccgtgccaatagcgatggtcaagtttacaagtcttcagcagcccttgattcgcaagtcatgtatgaagccttctcaaacttccaagcatttgcggacgatcagccagaactctacatgaaccgtgtcttggctaagaacactgacttgctcaaagcatggggtgttacgtctgttggacttccaccacagtacgtttcaagtaaggatggtaccttccttgattcaacaattgacaatggttatgcctttgatgaccgttatgacatggccttgagtcaaaataacaagtatggctcacttgaggacctccttaatgttcttcgtgccctccacaaagatggtattcaagccattgctgactgggtgccagaccaaatttataaccttccaggaaaagaagtagttaatgccacacgtgttaacggctacggttatcaccaacaaggttatcaaattgtggaccaagcctatgtggcaaatacccgtacagatggtacagactatcaaggtaaatacggtggagccttccttgatgagcttaaagctaagtacccatctattttcaaccgtgtgcaaatctcaaatggtaagcagttacctacgaatgaaaagattactaaatggtctgctaagtacttcaacggaactaatatccttggacgaggtatcaactatgtccttcgtgatgacaagaccaaccagtactttaatacctcagctaacagccaactcttgccaacaccacttcgtgacacaggtgccattacaagcactcaagtcttccaacgtcgtggacaagatgtttacttccttcgtgataaccaagccgttaagaatgaatttgttcaagacggtaacggcaactggtattacttcggtgctgacggtaagatgaccaagggtgctcaaaccatcaataaaaaggattactatttctttgacaatggtatccaattgcgtaacgcccttcgtcgtgctaacaacggttatacttactattacggtttagacggtgctatggttaagaatgcctttgttgattttgacgacaagcgtaagcaggtgcgtgcctttacgacacaaggataa

SEQ ID NO: 146 - protein, 1014 aa, artificial sequence
  T6 C-terminal truncation of GTF4336
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYFNDSDVPKNLLKRTDWNGNLTFNANDVFGVENVQVSGYLGVWVPVGAKANQDARTQPSNRANSDGQVYKSSAALDSQVMYEAFSNFQAFADDQPELYMNRVLAKNTDLLKAWGVTSVGLPPQYVSSKDGTFLDSTIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINYVLRDDKTNQYFNTSANSQLLPTPLRDTGAITSTQVFQRRGQDVYFLRDNQAVKNEFVQDGNGNWYYFGADGKMTKGAQTINKKDYYFFDNGIQLRNALRRANNGYTYYYGLDGAMVKNAFVDFDDKRKQVRAFTTQG

SEQ ID NO: 147 - DNA, 2727 bp, artificial sequence
  T1 C-terminal truncation of GTF4491
atcaacggcaaacaatactatgtcaatagtgacggtagtgtgcgtaagaactttgtttttgagcaagatggtaagtcttattactttgatgctgaaacaggggctcttgcgactaagtcacaggatgaattttcaacagaacctatcaaggcaaccgtagatttttcatctggtaaccagctctacaaaaacgatgacaaatctttggaccaacttgacaccttcatcacagcggatgcttggtaccgtccaaagagcattctcaaggatggtaagacttggacagcttcaactgaagctgacaaacgtcctctcttgatggtttggtggcctgacaagtctactcaggtcaactaccttaactacatgcaaaatcaaggtcttggtgcagggtcattttcaaccaactctagccaggaaagtctggaccaagctgctaaagcggttcagactaagattgaagaacgtatcgcgcgtgagggcaataccaactggttgcgtacaagtatcgaccagttcatcaagacacagccaggttggaatagtagcactgaaaatagttcatacgaccacttgcaaggcggacagttgctctttaacaacagtaagggtgatactggcaaccgtaccagccacgccaactctgactatcgtttgttaaaccgcacaccgactaaccagacgggtacacgtaagtacttcaaggataattctatcggtggtcttgagttcttgcttgccaacgatattgataactcaaacccagctgttcaggcagagcaacttaactggctccactttatgatgaatatcggaagcatcatggctaatgacccaactgccaactttgacggtttgcgtgtcgatgccttggacaatgtggatgccgacctgctccaaatcgcatcagactacttcaaagcagcctatggtgttgacaagtctgaagccaatgccatcaagcacttgtcatacttggaagcatggtctgccaacgacccatactacaacaaggacactaagggagcacaacttccgattgacaatgcccttcgtaatgccctcaccaacctcttgatgcgtgataaaaatacacgtatgcagcttggagacatgactgctttcatcaacagtagtttgaacccacgaggtgccaacgataaaaacggtgaacgtatggcaaactatattttcacccgtgcccatgatacagaagctcaaaccattattcaacgtatcattcgtgatcgtattaacccaaatttgtttggttataatttcacacgtgatgaaatcaagaaagccttcgagatttacaatgaggatattgataaggctcacaagacttatgcgtcatacaacttgccatctgtctatgccctcatgttgaccaataaggactctgtaacacgtgtttattacggagacctctaccgtgaagatggtcactacatggctaagaagacgccttactttgatgccatcgacaccctcttgcgtgcccgtatcaagtatgtagctggtggtcaagacatggaagtgaagaaagtcggaaatgacggcctcttgacatcagttcgttatggtaaaggtgccaataacagaactgatttgggaacttctgaaactcgtacgcaaggtatgggtgtcatcatgaccaacaactatgatttccgcttgggtagcaatgaaactgtaacgatgaacatgggtagagctcaccgtaatcagctttatcgaccattgcttttgacgacaaaggatggtatagcaacctacctcaacgattctgatgtgcctaaaaaccttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaataattgataatggttatgcctttgatgaccgttacgatatggccttgagtcaaaataataaatacggatcacttgaggacctccttaacgttcttcgtgccctccataaagacggtattcaagccattgctgactgggtaccagaccaaatctataacctcccaggaaaagaagtggtaaatgcgacacgtgttaacggctacggttatcaccaacaaggttatcaaattgtggaccaagcctatgtggcaaatacccgtacagatggtacagactatcaaggcaagtacggtggtgccttccttgatgagctgaaagctaagtacccatctattttcaaccgtgtgcaaatctcaaatggtaagcaattgcctacgaatgaaaagattacaaaatggtctgctaagtacttcaacggaaccaacatccttggacgaggcatcaactttgtccttcgtgatgacaagaccaaccagtactttaatacttcagctaacagccaactcttgccaacaccacttcgtgatacgggtgccatcacataa

SEQ ID NO: 148 - protein, 908 aa, artificial sequence
  T1 C-terminal truncation of GTF4491
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKNLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSIIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINFVLRDDKTNQYFNTSANSQLLPTPLRDTGAIT

SEQ ID NO: 149 - DNA, 2847 bp, artificial sequence
  T2 C-terminal truncation of GTF4491
atcaacggcaaacaatactatgtcaatagtgacggtagtgtgcgtaagaactttgtttttgagcaagatggtaagtcttattactttgatgctgaaacaggggctcttgcgactaagtcacaggatgaattttcaacagaacctatcaaggcaaccgtagatttttcatctggtaaccagctctacaaaaacgatgacaaatctttggaccaacttgacaccttcatcacagcggatgcttggtaccgtccaaagagcattctcaaggatggtaagacttggacagcttcaactgaagctgacaaacgtcctctcttgatggtttggtggcctgacaagtctactcaggtcaactaccttaactacatgcaaaatcaaggtcttggtgcagggtcattttcaaccaactctagccaggaaagtctggaccaagctgctaaagcggttcagactaagattgaagaacgtatcgcgcgtgagggcaataccaactggttgcgtacaagtatcgaccagttcatcaagacacagccaggttggaatagtagcactgaaaatagttcatacgaccacttgcaaggcggacagttgctctttaacaacagtaagggtgatactggcaaccgtaccagccacgccaactctgactatcgtttgttaaaccgcacaccgactaaccagacgggtacacgtaagtacttcaaggataattctatcggtggtcttgagttcttgcttgccaacgatattgataactcaaacccagctgttcaggcagagcaacttaactggctccactttatgatgaatatcggaagcatcatggctaatgacccaactgccaactttgacggtttgcgtgtcgatgccttggacaatgtggatgccgacctgctccaaatcgcatcagactacttcaaagcagcctatggtgttgacaagtctgaagccaatgccatcaagcacttgtcatacttggaagcatggtctgccaacgacccatactacaacaaggacactaagggagcacaacttccgattgacaatgcccttcgtaatgccctcaccaacctcttgatgcgtgataaaaatacacgtatgcagcttggagacatgactgctttcatcaacagtagtttgaacccacgaggtgccaacgataaaaacggtgaacgtatggcaaactatattttcacccgtgcccatgatacagaagctcaaaccattattcaacgtatcattcgtgatcgtattaacccaaatttgtttggttataatttcacacgtgatgaaatcaagaaagccttcgagatttacaatgaggatattgataaggctcacaagacttatgcgtcatacaacttgccatctgtctatgccctcatgttgaccaataaggactctgtaacacgtgtttattacggagacctctaccgtgaagatggtcactacatggctaagaagacgccttactttgatgccatcgacaccctcttgcgtgcccgtatcaagtatgtagctggtggtcaagacatggaagtgaagaaagtcggaaatgacggcctcttgacatcagttcgttatggtaaaggtgccaataacagaactgatttgggaacttctgaaactcgtacgcaaggtatgggtgtcatcatgaccaacaactatgatttccgcttgggtagcaatgaaactgtaacgatgaacatgggtagagctcaccgtaatcagctttatcgaccattgcttttgacgacaaaggatggtatagcaacctacctcaacgattctgatgtgcctaaaaaccttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaataattgataatggttatgcctttgatgaccgttacgatatggccttgagtcaaaataataaatacggatcacttgaggacctccttaacgttcttcgtgccctccataaagacggtattcaagccattgctgactgggtaccagaccaaatctataacctcccaggaaaagaagtggtaaatgcgacacgtgttaacggctacggttatcaccaacaaggttatcaaattgtggaccaagcctatgtggcaaatacccgtacagatggtacagactatcaaggcaagtacggtggtgccttccttgatgagctgaaagctaagtacccatctattttcaaccgtgtgcaaatctcaaatggtaagcaattgcctacgaatgaaaagattacaaaatggtctgctaagtacttcaacggaaccaacatccttggacgaggcatcaactttgtccttcgtgatgacaagaccaaccagtactttaatacttcagctaacagccaactcttgccaacaccacttcgtgatacgggtgccatcacaagcactcaagtcttccaacgtcgtggacaagatgtttacttccttcgcgataaccaaaccgttaagaatgaatttgttcaagacggtaacggtaactggtattacttcggtggtgacggttaa

SEQ ID NO: 150 - protein, 948 aa, artificial sequence
  T2 C-terminal truncation of GTF4491
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKNLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSIIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINFVLRDDKTNQYFNTSANSQLLPTPLRDTGAITSTQVFQRRGQDVYFLRDNQTVKNEFVQDGNGNWYYFGGDG

SEQ ID NO: 151 - DNA, 3045 bp, artificial sequence
  T6 C-terminal truncation of GTF4491
atcaacggcaaacaatactatgtcaatagtgacggtagtgtgcgtaagaactttgtttttgagcaagatggtaagtcttattactttgatgctgaaacaggggctcttgcgactaagtcacaggatgaattttcaacagaacctatcaaggcaaccgtagatttttcatctggtaaccagctctacaaaaacgatgacaaatctttggaccaacttgacaccttcatcacagcggatgcttggtaccgtccaaagagcattctcaaggatggtaagacttggacagcttcaactgaagctgacaaacgtcctctcttgatggtttggtggcctgacaagtctactcaggtcaactaccttaactacatgcaaaatcaaggtcttggtgcagggtcattttcaaccaactctagccaggaaagtctggaccaagctgctaaagcggttcagactaagattgaagaacgtatcgcgcgtgagggcaataccaactggttgcgtacaagtatcgaccagttcatcaagacacagccaggttggaatagtagcactgaaaatagttcatacgaccacttgcaaggcggacagttgctctttaacaacagtaagggtgatactggcaaccgtaccagccacgccaactctgactatcgtttgttaaaccgcacaccgactaaccagacgggtacacgtaagtacttcaaggataattctatcggtggtcttgagttcttgcttgccaacgatattgataactcaaacccagctgttcaggcagagcaacttaactggctccactttatgatgaatatcggaagcatcatggctaatgacccaactgccaactttgacggtttgcgtgtcgatgccttggacaatgtggatgccgacctgctccaaatcgcatcagactacttcaaagcagcctatggtgttgacaagtctgaagccaatgccatcaagcacttgtcatacttggaagcatggtctgccaacgacccatactacaacaaggacactaagggagcacaacttccgattgacaatgcccttcgtaatgccctcaccaacctcttgatgcgtgataaaaatacacgtatgcagcttggagacatgactgctttcatcaacagtagtttgaacccacgaggtgccaacgataaaaacggtgaacgtatggcaaactatattttcacccgtgcccatgatacagaagctcaaaccattattcaacgtatcattcgtgatcgtattaacccaaatttgtttggttataatttcacacgtgatgaaatcaagaaagccttcgagatttacaatgaggatattgataaggctcacaagacttatgcgtcatacaacttgccatctgtctatgccctcatgttgaccaataaggactctgtaacacgtgtttattacggagacctctaccgtgaagatggtcactacatggctaagaagacgccttactttgatgccatcgacaccctcttgcgtgcccgtatcaagtatgtagctggtggtcaagacatggaagtgaagaaagtcggaaatgacggcctcttgacatcagttcgttatggtaaaggtgccaataacagaactgatttgggaacttctgaaactcgtacgcaaggtatgggtgtcatcatgaccaacaactatgatttccgcttgggtagcaatgaaactgtaacgatgaacatgggtagagctcaccgtaatcagctttatcgaccattgcttttgacgacaaaggatggtatagcaacctacctcaacgattctgatgtgcctaaaaaccttctgaaacgtactgactggaatgggaacttgaccttcaatgccaacgatgttttcggtgtagaaaatgtccaagtctcaggttacctcggtgtctgggtaccatacggagctaaggctaatcaagatgcacgtacacagccaagtaatcgtgccaatagcgacggtcaagtttacaagtcttcagcagcccttgattcgcaagtcatgtatgaagccttctcaaacttccaagcctttgcggacgatcaacctgaactttacatgaaccgtgtcttggctaagaacactgacttgctcaaagcatgggggatcacgtcagtcggacttccaccacagtacgtttcaagtaaggatggcaccttccttgactcaataattgataatggttatgcctttgatgaccgttacgatatggccttgagtcaaaataataaatacggatcacttgaggacctccttaacgttcttcgtgccctccataaagacggtattcaagccattgctgactgggtaccagaccaaatctataacctcccaggaaaagaagtggtaaatgcgacacgtgttaacggctacggttatcaccaacaaggttatcaaattgtggaccaagcctatgtggcaaatacccgtacagatggtacagactatcaaggcaagtacggtggtgccttccttgatgagctgaaagctaagtacccatctattttcaaccgtgtgcaaatctcaaatggtaagcaattgcctacgaatgaaaagattacaaaatggtctgctaagtacttcaacggaaccaacatccttggacgaggcatcaactttgtccttcgtgatgacaagaccaaccagtactttaatacttcagctaacagccaactcttgccaacaccacttcgtgatacgggtgccatcacaagcactcaagtcttccaacgtcgtggacaagatgtttacttccttcgcgataaccaaaccgttaagaatgaatttgttcaagacggtaacggtaactggtattacttcggtggtgacggtaagatgaccaagggtgcccaaaacatcaatagcaaggattactatttctttgataatggtgttcaattgcgtaatgccctgcgtcgtgcttcaaacggctatacttactattacggtctggacggtgctatggttaagaatgccttcgttgattttgatgacaagcataagcaggtccgtgcctttacgactcaaggataa

SEQ ID NO: 152 - protein, 1014 aa, artificial sequence
  T6 C-terminal truncation of GTF4491
INGKQYYVNSDGSVRKNFVFEQDGKSYYFDAETGALATKSQDEFSTEPIKATVDFSSGNQLYKNDDKSLDQLDTFITADAWYRPKSILKDGKTWTASTEADKRPLLMVWWPDKSTQVNYLNYMQNQGLGAGSFSTNSSQESLDQAAKAVQTKIEERIAREGNTNWLRTSIDQFIKTQPGWNSSTENSSYDHLQGGQLLFNNSKGDTGNRTSHANSDYRLLNRTPTNQTGTRKYFKDNSIGGLEFLLANDIDNSNPAVQAEQLNWLHFMMNIGSIMANDPTANFDGLRVDALDNVDADLLQIASDYFKAAYGVDKSEANAIKHLSYLEAWSANDPYYNKDTKGAQLPIDNALRNALTNLLMRDKNTRMQLGDMTAFINSSLNPRGANDKNGERMANYIFTRAHDTEAQTIIQRIIRDRINPNLFGYNFTRDEIKKAFEIYNEDIDKAHKTYASYNLPSVYALMLTNKDSVTRVYYGDLYREDGHYMAKKTPYFDAIDTLLRARIKYVAGGQDMEVKKVGNDGLLTSVRYGKGANNRTDLGTSETRTQGMGVIMTNNYDFRLGSNETVTMNMGRAHRNQLYRPLLLTTKDGIATYLNDSDVPKNLLKRTDWNGNLTFNANDVFGVENVQVSGYLGVWVPYGAKANQDARTQPSNRANSDGQVYKSSAALDSQVMYEAFSNFQAFADDQPELYMNRVLAKNTDLLKAWGITSVGLPPQYVSSKDGTFLDSIIDNGYAFDDRYDMALSQNNKYGSLEDLLNVLRALHKDGIQAIADWVPDQIYNLPGKEVVNATRVNGYGYHQQGYQIVDQAYVANTRTDGTDYQGKYGGAFLDELKAKYPSIFNRVQISNGKQLPTNEKITKWSAKYFNGTNILGRGINFVLRDDKTNQYFNTSANSQLLPTPLRDTGAITSTQVFQRRGQDVYFLRDNQTVKNEFVQDGNGNWYYFGGDGKMTKGAQNINSKDYYFFDNGVQLRNALRRASNGYTYYYGLDGAMVKNAFVDFDDKHKQVRAFTTQG

SEQ ID NO: 153 - protein, 588 aa, artificial sequence
  consensus sequence of aligned region of GTF0459 and homologs
  MISC_FEATURE (1)..(50): Xaa at positions 1-50  may be any naturally-occurring amino acid and up to 50 of them may be absent.
  MISC_FEATURE (51)..(51): Xaa at position 51 is Phe or Leu
  MISC_FEATURE (52)..(99): Xaa at positions 52-99  may be any naturally-occurring amino acid and up to 48 of them may be absent.
  MISC_FEATURE (100)..(100): Xaa at position 100 is Val or Leu
  MISC_FEATURE (101)..(139): Xaa at positions 101-139  may be any naturally-occurring amino acid and up to 39 of them may be absent.
  MISC_FEATURE (140)..(140): Xaa at position 140 is Ala or Leu
  MISC_FEATURE (141)..(155): Xaa at positions 141-155  may be any naturally-occurring amino acid and up to 15 of them may be absent.
  MISC_FEATURE (156)..(156): Xaa at position 156 is Met or Ile
  MISC_FEATURE (157)..(158): Xaa at positions 157-158  may be any naturally-occurring amino acid and up to 2 of them may be absent.
  MISC_FEATURE (159)..(159): Xaa at position 159 is Lys or Ala
  MISC_FEATURE (160)..(161): Xaa at positions 160-161  may be any naturally-occurring amino acid and up to 2 of them may be absent.
  MISC_FEATURE (162)..(162): Xaa at position 162 is Leu or Asn
  MISC_FEATURE (163)..(164): Xaa at positions 163-164  may be any naturally-occurring amino acid and up to 2 of them may be absent.
  MISC_FEATURE (165)..(165): Xaa at position 165 is Leu or Thr
  MISC_FEATURE (166)..(166): Xaa at position 166 is Phe or Asn
  MISC_FEATURE (167)..(209): Xaa at positions 167-209  may be any naturally-occurring amino acid and up to 43 of them may be absent.
  MISC_FEATURE (210)..(210): Xaa at position 210 is Ala or Gly
  MISC_FEATURE (211)..(212): Xaa at positions 211-212  may be any naturally-occurring amino acid and up to 2 of them may be absent.
  MISC_FEATURE (213)..(213): Xaa at position 213 is Asn or Thr
  MISC_FEATURE (214)..(214): Xaa at position 214 is Asn or Glu
  MISC_FEATURE (215)..(216): Xaa at positions 215-216  may be any naturally-occurring amino acid and up to 2 of them may be absent.
  MISC_FEATURE (217)..(217): Xaa at position 217 is Asp or Thr
  MISC_FEATURE (218)..(233): Xaa at positions 218-233  may be any naturally-occurring amino acid and up to 16 of them may be absent.
  MISC_FEATURE (234)..(234): Xaa at position 234 is Phe or Tyr
  MISC_FEATURE (235)..(519): Xaa at positions 235-519  may be any naturally-occurring amino acid and up to 285 of them may be absent.
  MISC_FEATURE (520)..(520): Xaa at position 520 is Glu or Gly
  MISC_FEATURE (521)..(588): Xaa at positions 521-588  may be any naturally-occurring amino acid and up to 68 of them may be absent.
LXXXXXXXXXXXXXXXXXXXXXXXXXXXXXXXXXXXXXXXXXXXXXXXGGXXXLLXXXXXXXXXXXXXXXXXXXXXXXXXXXXXXXXXXXXXXXXRVDAXDNVXXXXXXXXXXXXXXXXXXXXXXXXXXXXXXXXEAWSXXDXXXXXXXXXXXXXXXNXXRXXXXXXXXXXXXXXXXXXXXXXXXXXXXXXXXXXXXXXXXXXXXXXXXXHDXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXFXNXXXXXXXXXXXXXXXXXXXXXXXXXXXXXXXXXXXPXXXXXXXXXFLDSXXXNGYAFXXXXXXXXXXXXXXXXXXXXXXXXXXXXXXXXXXXXDWVPDQIY

What is claimed is:

1. A composition comprising an alpha-glucan ether, wherein the glycosidic linkages of the alpha-glucan ether comprise:

(i) at least 75% alpha-1,3 glycosidic linkages, (ii) less than 25% alpha-1,6 glycosidic linkages, and (iii) less than 10% alpha-1,3,6 glycosidic linkages, wherein the percent glycosidic linkages of the alpha-glucan are determined by methylation analysis, wherein the alpha-glucan ether has a degree of substitution (DoS) with at least one organic group in ether linkage that is no higher than 3.0, wherein the alpha-glucan ether comprises at least one substructure —$C_G$—O—C—, wherein "—$C_G$—" of said substructure represents carbon atom 2, 4, or 6 of a glucose monomeric unit of the alpha-glucan ether, and "—C—" of said substructure represents a carbon atom of said organic group that is in said ether linkage.

2. The composition of claim 1, wherein said DoS is about 0.05 to about 3.0.

3. The composition of claim 1, wherein the organic group is carboxy alkyl, hydroxy alkyl, or alkyl.

4. The composition of claim 1, wherein the organic group is carboxymethyl.

5. The composition of claim 1, wherein the organic group is hydroxypropyl, dihydroxypropyl, hydroxyethyl, methyl, or ethyl.

6. The composition of claim 1, wherein the organic group is an uncharged organic group.

7. The composition of claim 1, wherein the organic group is an anionic organic group.

8. The composition of claim 1, wherein the organic group is a positively charged organic group.

9. The composition of claim 8, wherein the positively charged organic group is a quaternary ammonium group.

10. The composition of claim 8, wherein the positively charged organic group is a substituted ammonium group.

11. The composition of claim 10, wherein the substituted ammonium group is trialkylammonium.

12. The composition of claim 11, wherein the trialkylammonium is trimethylammonium.

13. The composition of claim 8, wherein the positively charged organic group is a quaternary ammonium hydroxypropyl group.

14. The composition of claim 1, wherein the composition further comprises at least one of a surfactant selected from anionic surfactants, nonionic surfactants, cationic surfactants, or zwitterionic surfactants; enzyme selected from proteases, cellulases, polyesterases, amylases, cutinases, lipases, pectate lyases, perhydrolases, xylanases, peroxidases, or laccases; detergent builder; complexing agent; soil release polymer; surfactancy-boosting polymer; bleaching system; bleach activator; bleaching catalyst; fabric conditioner; clay; foam booster; suds suppressor; anti-corrosion agent; soil-suspending agent; anti-soil redeposition agent; dye; bactericide; tarnish inhibiter; optical brightener; perfume; saturated or unsaturated fatty acid; dye transfer inhibiting agent; chelating agent; hueing dye; calcium or magnesium cation; visual signaling ingredient; anti-foam; structurant; thickener; anti-caking agent; starch; sand; or gelling agent.

15. The composition of claim 1, wherein the composition is in the form of a liquid, gel, powder, hydrocolloid, aqueous solution, granule, tablet, capsule, single-compartment sachet, or multi-compartment sachet.

16. The composition of claim 1, wherein the composition is a fabric care composition.

17. The composition of claim 1, wherein the composition is a dishwashing detergent composition.

18. The composition of claim 17, wherein the dishwashing detergent composition is an automatic dishwashing detergent composition.

19. A method of treating a fabric, textile, or article of clothing, said method comprising:

(a) providing a composition according to claim 16;

(b) contacting, under suitable conditions, the composition of (a) with a fabric, textile, or article of clothing, whereby the fabric, textile, or article of clothing is treated by the composition; and (c) optionally, rinsing the treated fabric, textile, or article of clothing of (b).

20. A method of treating a dish, said method comprising:

(a) providing a composition according to claim 17;

(b) contacting, under suitable conditions, the composition of (a) with an article selected from a dish, glass, pot, pan, baking dish, utensil, flatware, or tableware, whereby the article is treated by the composition; and (c) optionally, rinsing the treated article of (b).

21. The composition of claim 1, wherein the composition is a personal care composition.

22. The composition of claim 21, wherein the personal care composition is:

a lotion, cream, paste, balm, ointment, pomade, gel, liquid, emulsion, or dispersion;

(ii) a cosmetic;

(iii) a shampoo, hair conditioner, bath gel, shower gel, body wash, or soap;

(iv) a skin conditioner, sunscreen/sunblock, moisturizer, body spray, skin gel, or nail conditioner; or (v) a mousse, hair spray, styling gel, or hair serum.

23. The composition of claim 1, wherein the alpha-glucan ether is crosslinked.

24. The composition of claim 21, wherein the alpha-glucan ether is crosslinked.

25. The composition of claim 22, wherein the alpha-glucan ether is crosslinked.

26. The composition of claim 1, wherein the composition is a wipe, pad, or sponge.

* * * * *